United States Patent
Izhar et al.

(10) Patent No.: US 12,168,062 B2
(45) Date of Patent: Dec. 17, 2024

(54) GUIDE RNA THAT TARGETS A MUTANT HUMAN GUANYLATE CYCLASE 2A ALLELE

(71) Applicant: EmendoBio Inc., Wilmington, DE (US)

(72) Inventors: Lior Izhar, Tel Aviv (IL); David Baram, Nir Zvi (IL); Joe Georgeson, Rehevot (IL); Michal Golan-Mashiach, Ness-Ziona (IL); Asael Herman, Ness-Ziona (IL); Rafi Emmanuel, Ramla (IL)

(73) Assignee: EmendoBio Inc., Wilmington, DE (US)

( * ) Notice: Subject to any disclaimer, the term of this patent is extended or adjusted under 35 U.S.C. 154(b) by 0 days.

(21) Appl. No.: 16/203,004

(22) Filed: Nov. 28, 2018

(65) Prior Publication Data
US 2023/0173106 A1    Jun. 8, 2023

Related U.S. Application Data

(60) Provisional application No. 62/680,479, filed on Jun. 4, 2018, provisional application No. 62/591,333, filed on Nov. 28, 2017.

(51) Int. Cl.
| | |
|---|---|
| *C12N 15/11* | (2006.01) |
| *A61K 48/00* | (2006.01) |
| *A61P 27/00* | (2006.01) |
| *C12N 9/22* | (2006.01) |
| *C12N 15/113* | (2010.01) |

(52) U.S. Cl.
CPC .......... *A61K 48/0066* (2013.01); *A61P 27/00* (2018.01); *C12N 9/22* (2013.01); *C12N 15/11* (2013.01); *C12N 15/113* (2013.01); *C12N 15/1137* (2013.01); *C12Y 301/00* (2013.01)

(58) Field of Classification Search
CPC .......... C12N 15/113; C12N 9/22; A61P 27/00
USPC ........................................................ 514/44
See application file for complete search history.

(56) References Cited

FOREIGN PATENT DOCUMENTS

| | | |
|---|---|---|
| WO | PCT/US18/62871 | 11/2018 |
| WO | PCT/US19/23715 | 3/2019 |

OTHER PUBLICATIONS

Payne (J Med Genetics, 2001, vol. 38, p. 611-647).*
Mukherjee (Eye, 2014, vol. 28, p. 481-487).*
Sun (Ophthalmic Genetics, 2020, vol. 41, No. 6, p. 548-555).*
Jinke (Science, 2012, vol. 337, p. 816-821).*
Turk, 2017, "Similar editing efficiency with 2-part and single guide RNA".*
Christie (Mol. Therapy, 2020, vol. 28, No. 8, p. 1846-1857.*
U.S. Appl. No. 16/202,955, filed Nov. 28, 2018, Izhar.
U.S. Appl. No. 16/202,867, filed Nov. 28, 2018, Izhar.
U.S. Appl. No. 16/203,056, filed Nov. 28, 2018, Izhar.
U.S. Appl. No. 16/203,094, filed Nov. 28, 2018, Izhar.
U.S. Appl. No. 16/203,134, filed Nov. 28, 2018, Izhar.
U.S. Appl. No. 16/203,169, filed Nov. 28, 2018, Izhar.
U.S. Appl. No. 16/203,231, filed Nov. 28, 2018, Izhar.
Burstein et al. (2017), "New CRISPR-Cas systems from uncultivated microbes," Nature 542:237-41.
Sentmanat et al. (2018), "A Survey of Validation Strategies for CRISPR-Cas9 Editing," Scientific Reports 8:888, doi: 10.1038/s41598-018-19441-8.
Zuris et al. (2015), "Cationic lipid-mediated delivery of proteins enables efficient protein based genome editing in vitro and in vivo," Nat Biotechnol. 33(1):73-80.
Buch et al., "AAV-mediated gene therapy for retinal disorders: from mouse to man" Gene Therapy (2008) 15, 849-857.
Han Z et al. (2012), "Comparative Analysis of DNA Nanoparticles and AAVs for Ocular Gene Delivery" PLoS One 7(12): e52189.
Ralph et al., "Gene therapy for neurodegenerative and ocular diseases using lentiviral vectors" Clinical Science (2006), 110, 37-46.
Wang et al. J. "Lipid Nanoparticles for Ocular Gene Therapy" Funct. Biomater. 2015, 6, 379-394.

* cited by examiner

*Primary Examiner* — Michael C Wilson
(74) *Attorney, Agent, or Firm* — Potomac Law Group, PLLC; Jamaica Szeliga

(57) ABSTRACT

RNA molecules comprising a guide sequence portion having 17-20 nucleotides in the sequence of 17-20 contiguous nucleotides set forth in any one of SEQ ID NOs: 1-3010 and compositions, methods, and uses thereof.

6 Claims, No Drawings

Specification includes a Sequence Listing.

GUIDE RNA THAT TARGETS A MUTANT HUMAN GUANYLATE CYCLASE 2A ALLELE

This application claims the benefit of U.S. Provisional Application No. 62/680,479, filed Jun. 4, 2018 and U.S. Provisional Application No. 62/591,333, filed Nov. 28, 2017, the contents of each of which are hereby incorporated by reference.

Throughout this application, various publications are referenced, including referenced in parenthesis. The disclosures of all publications mentioned in this application in their entireties are hereby incorporated by reference into this application in order to provide additional description of the art to which this invention pertains and of the features in the art which can be employed with this invention.

REFERENCE TO SEQUENCE LISTING

This application incorporates-by-reference nucleotide sequences which are present in the filed named "210702 90237-A_SubstituteSequenceListing_DH. txt", which is 551 kilobytes in size, and which was created on Jun. 30, 2021 in the IBM-PC machine format, having an operating system compatibility with MS-Windows, which is contained in the text file filed Jul. 2, 2021 as part of this application.

BACKGROUND OF INVENTION

There are several classes of DNA variation in the human genome, including insertions and deletions, differences in the copy number of repeated sequences, and single nucleotide polymorphisms (SNPs). A SNP is a DNA sequence variation occurring when a single nucleotide (adenine (A), thymine (T), cytosine (C), or guanine (G)) in the genome differs between human subjects or paired chromosomes in an individual. Over the years, the different types of DNA variations have been the focus of the research community either as markers in studies to pinpoint traits or disease causation or as potential causes of genetic disorders.

A genetic disorder is caused by one or more abnormalities in the genome. Genetic disorders may be regarded as either "dominant" or "recessive." Recessive genetic disorders are those which require two copies (i.e., two alleles) of the abnormal/defective gene to be present. In contrast, a dominant genetic disorder involves a gene or genes which exhibit(s) dominance over a normal (functional/healthy) gene or genes. As such, in dominant genetic disorders only a single copy (i.e., allele) of an abnormal gene is required to cause or contribute to the symptoms of a particular genetic disorder. Such mutations include, for example, gain-of-function mutations in which the altered gene product possesses a new molecular function or a new pattern of gene expression. Other examples include dominant negative mutations, which have a gene product that acts antagonistically to the wild-type allele.

Cone Rod Dystrophy

The cone-rod dystrophies (CORD) are a heterogeneous group of progressive genetically determined retinal disorders, which may be inherited as an autosomal dominant, autosomal recessive, or X-linked trait. Typically, they are characterized clinically by a loss of visual acuity, abnormal color vision, photophobia, and visual field loss and may develop macular atrophy. Mutations in the gene 'Guanylate cyclase 2D, membrane (retina-specific)' (GUCY2D) have been demonstrated to be associated with an autosomal dominant CORD.

SUMMARY OF THE INVENTION

Disclosed is an approach for knocking out the expression of a dominant-mutated allele by disrupting the dominant-mutated allele or degrading the resulting mRNA.

The present disclosure provides a method for utilizing at least one naturally occurring nucleotide difference or polymorphism (e.g., single nucleotide polymorphism (SNP)) for distinguishing/discriminating between two alleles of a gene, one allele bearing a mutation such that it encodes a mutated protein causing a disease phenotype ("mutated allele"), and the other allele encoding for a functional protein ("functional allele"). In some embodiments, the method further comprises the step of knocking out expression of the mutated protein and allowing expression of the functional protein.

According to embodiments of the present invention, there is provided a first RNA molecule comprising a guide sequence portion having 17-20 nucleotides in the sequence of 17-20 contiguous nucleotides set forth in any one of SEQ ID NOs: 1-3010.

According to embodiments of the present invention, there is provided a first RNA molecule comprising a guide sequence portion having 17-20 contiguous nucleotides set forth in any one of SEQ ID NOs: 1-3010.

According to some embodiments of the present invention, there is provided a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a method for inactivating a mutant GUCY2D allele in a cell, the method comprising delivering to the cell a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a method for treating CORD, the method comprising delivering to a subject having CORD a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided use of a composition comprising an RNA molecule comprising a guide sequence portion having 17-20 nucleotides in the sequence of 17-20 contiguous nucleotides set forth in any one of SEQ ID NOs: 1-3010 and a CRISPR nuclease for inactivating a mutant GUCY2D allele in a cell, comprising delivering to the cell the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to embodiments of the present invention, there is provided a medicament comprising an RNA molecule comprising a guide sequence portion having 17-20 nucleotides in the sequence of 17-20 contiguous nucleotides set forth in any one of SEQ ID NOs: 1-3010 and a CRISPR nuclease for use in inactivating a mutant GUCY2D allele in a cell, wherein the medicament is administered by delivering to the cell the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided use of a composition comprising an RNA molecule comprising a guide sequence portion having 17-20 nucleotides in the sequence of 17-20 contiguous nucleotides set forth in any one of SEQ ID NOs: 1-3010 and a CRISPR nuclease for treating ameliorating or preventing CORD, comprising delivering to a subject having or at risk of having CORD the composition of comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a medicament comprising the composition comprising an RNA molecule comprising a guide sequence portion having 17-20 nucleotides in the sequence of 17-20 contiguous nucleotides set forth in any one of SEQ ID NOs: 1-3010 and a CRISPR nuclease for use in treating ameliorating or preventing CORD, wherein the medicament is administered by delivering to a subject having or at risk of having CORD the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a kit for inactivating a mutant GUCY2D allele in a cell, comprising an RNA molecule comprising a guide sequence portion having 17-20 nucleotides in the sequence of 17-20 contiguous nucleotides set forth in any one of SEQ ID NOs: 1-3010, a CRISPR nuclease, and/or a tracrRNA molecule; and instructions for delivering the RNA molecule; CRISPR nuclease, and/or the tracrRNA to the cell.

According to some embodiments of the present invention, there is provided a kit for treating CORD in a subject, comprising an RNA molecule comprising a guide sequence portion having 17-20 nucleotides in the sequence of 17-20 contiguous nucleotides set forth in any one of SEQ ID NOs: 1-3010, a CRISPR nuclease, and/or a tracrRNA molecule; and instructions for delivering the RNA molecule; CRISPR nuclease, and/or the tracrRNA to a subject having or at risk of having CORD.

DETAILED DESCRIPTION

Definitions

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

It should be understood that the terms "a" and "an" as used above and elsewhere herein refer to "one or more" of the enumerated components. It will be clear to one of ordinary skill in the art that the use of the singular includes the plural unless specifically stated otherwise. Therefore, the terms "a," "an" and "at least one" are used interchangeably in this application.

For purposes of better understanding the present teachings and in no way limiting the scope of the teachings, unless otherwise indicated, all numbers expressing quantities, percentages or proportions, and other numerical values used in the specification and claims, are to be understood as being modified in all instances by the term "about." Accordingly, unless indicated to the contrary, the numerical parameters set forth in the following specification and attached claims are approximations that may vary depending upon the desired properties sought to be obtained. At the very least, each numerical parameter should at least be construed in light of the number of reported significant digits and by applying ordinary rounding techniques.

Unless otherwise stated, adjectives such as "substantially" and "about" modifying a condition or relationship characteristic of a feature or features of an embodiment of the invention, are understood to mean that the condition or characteristic is defined to within tolerances that are acceptable for operation of the embodiment for an application for which it is intended. Unless otherwise indicated, the word "or" in the specification and claims is considered to be the inclusive "or" rather than the exclusive or, and indicates at least one of, or any combination of items it conjoins.

In the description and claims of the present application, each of the verbs, "comprise," "include" and "have" and conjugates thereof, are used to indicate that the object or objects of the verb are not necessarily a complete listing of components, elements or parts of the subject or subjects of the verb. Other terms as used herein are meant to be defined by their well-known meanings in the art.

The "guide sequence portion" of an RNA molecule refers to a nucleotide sequence that is capable of hybridizing to a specific target DNA sequence, e.g., the guide sequence portion has a nucleotide sequence which is fully complementary to said target DNA sequence. In some embodiments, the guide sequence portion is 17, 18, 19, 20, 21, 22, 23, or 24 nucleotides in length, or approximately 17-24, 18-22, 19-22, 18-20, or 17-20 nucleotides in length. The guide sequence portion may be part of an RNA molecule that can form a complex with a CRISPR nuclease with the guide sequence portion serving as the DNA targeting portion of the CRISPR complex. When the DNA molecule having the guide sequence portion is present contemporaneously with the CRISPR molecule the RNA molecule is capable of targeting the CRISPR nuclease to the specific target DNA sequence. Each possibility represents a separate embodiment. An RNA molecule can be custom designed to target any desired sequence.

In embodiments of the present invention, an RNA molecule comprises a guide sequence portion having 17-20 nucleotides in the sequence of 17-20 contiguous nucleotides set forth in any one of SEQ ID NOs: 1-3010, 1-742, or 743-3010.

As used herein, "contiguous nucleotides" set forth in a SEQ ID NO refers to nucleotides in a sequence of nucleotides in the order set forth in the SEQ ID NO without any intervening nucleotides.

In embodiments of the present invention, the guide sequence portion may be 20 nucleotides in length and consists of 20 nucleotides in the sequence of 20 contiguous nucleotides set forth in any one of SEQ ID NOs: 1-3010. In embodiments of the present invention, the guide sequence portion may be less than 20 nucleotides in length. For example, in embodiments of the present invention the guide sequence portion may be 17, 18, or 19 nucleotides in length. In such embodiments the guide sequence portion may consist of 17, 18, or 19 nucleotides, respectively, in the sequence of 17-20 contiguous nucleotides set forth in any one of SEQ ID NOs: 1-3010. For example, a guide sequence portion having 17 nucleotides in the sequence of 17 contiguous nucleotides set forth in SEQ ID NO: 1 may consist of any one of the following nucleotide sequences (nucleotides excluded from the contiguous sequence are marked in strike-through):

SEQ ID NO: 1
UGUGCUUCUCCUUAGGGUCU 17 nucleotide guide sequence 1:
~~UGU~~ GCUUCUCCUUAGGGUCU 17 nucleotide guide sequence 2:
~~UG~~ UGCUUCUCCUUAGGGUC ~~U~~

17 nucleotide guide sequence 3:
~~U~~ GCUUCUCCUUAGGGU ~~CU~~

17 nucleotide guide sequence 4:
UGUGCUUCUCCUUAGGG ~~UCU~~

In embodiments of the present invention, the guide sequence portion may be greater than 20 nucleotides in length. For example, in embodiments of the present invention the guide sequence portion may be 21, 22, 23, or 24 nucleotides in length. In such embodiments the guide sequence portion comprises 20 nucleotides in the sequence of 20 contiguous nucleotides set forth in any one of SEQ ID NOs: 1-3010 and additional nucleotides fully complimentary to a nucleotide or sequence of nucleotides adjacent to the 3' end of the target sequence, 5' end of the target sequence, or both.

In embodiments of the present invention a CRISPR nuclease and an RNA molecule comprising a guide sequence portion form a CRISPR complex that binds to a target DNA sequence to effect cleavage of the target DNA sequence. CRISPR nucleases, e.g. Cpf1, may form a CRISPR complex comprising a CRISPR nuclease and RNA molecule without a further tracrRNA molecule. Alternatively, CRISPR nucleases, e.g. Cas9, may form a CRISPR complex between the CRISPR nuclease, an RNA molecule, and a tracrRNA molecule.

In embodiments of the present invention, the RNA molecule may further comprise the sequence of a tracrRNA molecule. Such embodiments may be designed as a synthetic fusion of the guide portion of the RNA molecule and the trans-activating crRNA (tracrRNA). (See Jinek (2012) Science). Embodiments of the present invention may also form CRISPR complexes utilizing a separate tracrRNA molecule and a separate RNA molecule comprising a guide sequence portion. In such embodiments the tracrRNA molecule may hybridize with the RNA molecule via basepairing and may be advantageous in certain applications of the invention described herein.

The term "tracr mate sequence" refers to a sequence sufficiently complementary to a tracrRNA molecule so as to hybridize to the tracrRNA via basepairing and promote the formation of a CRISPR complex. (See e.g., U.S. Pat. No. 8,906,616). In embodiments of the present invention, the RNA molecule may further comprise a portion having a tracr mate sequence.

A "gene," for the purposes of the present disclosure, includes a DNA region encoding a gene product, as well as all DNA regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

"Eukaryotic" cells include, but are not limited to, fungal cells (such as yeast), plant cells, animal cells, mammalian cells and human cells.

The term "nuclease" as used herein refers to an enzyme capable of cleaving the phosphodiester bonds between the nucleotide subunits of nucleic acid. A nuclease may be isolated or derived from a natural source. The natural source may be any living organism. Alternatively, a nuclease may be a modified or a synthetic protein which retains the phosphodiester bond cleaving activity. Gene modification can be achieved using a nuclease, for example a CRISPR nuclease.

Embodiments

The present disclosure provides a method for utilizing at least one naturally occurring nucleotide difference or polymorphism (e.g., single nucleotide polymorphism (SNP)) for distinguishing/discriminating between two alleles of a gene, one allele bearing a mutation such that it encodes a mutated protein causing a disease phenotype ("mutated allele"), and the other allele encoding for a functional protein ("functional allele"). The method further comprises the step of knocking out expression of the mutated protein and allowing expression of the functional protein. In some embodiments, the method is for treating, ameliorating, or preventing a dominant negative genetic disorder.

According to embodiments of the present invention, there is provided a first RNA molecule comprising a guide sequence portion having 17-20 nucleotides in the sequence of 17-20 contiguous nucleotides set forth in any one of SEQ ID NOs: 1-3010.

According to embodiments of the present invention, there is provided a first RNA molecule comprising a guide sequence portion having 17-20 contiguous nucleotides set forth in any one of SEQ ID NOs: 1-3010.

According to embodiments of the present invention, an RNA molecule may further comprise a portion having a sequence which binds to a CRISPR nuclease.

According to embodiments of the present invention, the sequence which binds to a CRISPR nuclease is a tracrRNA sequence.

According to embodiments of the present invention, an RNA molecule may further comprise a portion having a tracr mate sequence.

According to embodiments of the present invention, an RNA molecule may further comprise one or more linker portions.

According to embodiments of the present invention, an RNA molecule may be up to 300, 290, 280, 270, 260, 250, 240, 230, 220, 210, 200, 190, 180, 170, 160, 150, 140, 130, 120, 110, or 100 nucleotides in length. Each possibility represents a separate embodiment. In embodiments of the present invention, the RNA molecule may be 17 up to 300 nucleotides in length, 100 up to 300 nucleotides in length, 150 up to 300 nucleotides in length, 200 up to 300 nucleotides in length, 100 to 200 nucleotides in length, or 150 up to 250 nucleotides in length. Each possibility represents a separate embodiment.

According to some embodiments of the present invention, there is provided a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to embodiments of the present invention, the composition may comprise a second RNA molecule comprising a guide sequence portion.

According to embodiments of the present invention, the guide sequence portion of the second RNA molecule comprises 17-20 nucleotides in the sequence of 17-20 contiguous nucleotides set forth in any one of SEQ ID NOs: 1-3010.

According to embodiments of the present invention, the 17-20 nucleotides of the guide sequence portion of the second RNA molecule are in a different sequence from the sequence of the guide sequence portion of the first RNA molecule Embodiments of the present invention may comprise a tracrRNA molecule.

According to some embodiments of the present invention, there is provided a method for inactivating a mutant GUCY2D allele in a cell, the method comprising delivering to the cell a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a method for treating CORD, the method comprising delivering to a subject having CORD a composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to embodiments of the present invention, the composition comprises a second RNA molecule comprising a guide sequence portion having 17-20 nucleotides in the sequence of 17-20 contiguous nucleotides set forth in any one of SEQ ID NOs: 1-3010.

According to embodiments of the present invention, the 17-20 nucleotides of the guide sequence portion of the second RNA molecule are in a different sequence from the sequence of the guide sequence portion of the first RNA molecule According to embodiments of the present invention, the CRISPR nuclease and the RNA molecule or RNA molecules are delivered to the subject and/or cells substantially at the same time or at different times.

According to embodiments of the present invention, the tracrRNA is delivered to the subject and/or cells substantially at the same time or at different times as the CRISPR nuclease and RNA molecule or RNA molecules.

According to embodiments of the present invention, the first RNA molecule targets a SNP or disease-causing mutation in an exon or promoter of a mutated allele, and wherein the second RNA molecule targets a SNP in the same or a different exon of the mutated allele, a SNP in an intron, or a sequence in an intron present in both the mutated or functional allele.

According to embodiments of the present invention, the first RNA molecule or the first and the second RNA molecules target a SNP in the promoter region, the start codon, or the untranslated region (UTR) of a mutated allele.

According to embodiments of the present invention, the first RNA molecule or the first and the second RNA molecules targets at least a portion of the promoter and/or the start codon and/or a portion of the UTR of a mutated allele.

According to embodiments of the present invention, the first RNA molecule targets a portion of the promoter, a first SNP in the promoter, or a SNP upstream to the promoter of a mutated allele and the second RNA molecule is targets a second SNP, which is downstream of the first SNP, and is in the promoter, in the UTR, or in an intron or in an exon of a mutated allele.

According to embodiments of the present invention, the first RNA molecule targets a SNP in the promoter, upstream of the promoter, or the UTR of a mutated allele and the second RNA molecule is designed to target a sequence which is present in an intron of both the mutated allele and the functional allele.

According to embodiments of the present invention, the first RNA molecule targets a sequence upstream of the promotor which is present in both a mutated and functional allele and the second RNA molecule targets a SNP or disease-causing mutation in any location of the gene.

According to embodiments of the present invention, there is provided a method comprising removing an exon containing a disease-causing mutation from a mutated allele, wherein the first RNA molecule or the first and the second RNA molecules target regions flanking an entire exon or a portion of the exon.

According to embodiments of the present invention, there is provided a method comprising removing multiple exons, the entire open reading frame of a gene, or removing the entire gene.

According to embodiments of the present invention, the first RNA molecule targets a SNP or disease-causing mutation in an exon or promoter of a mutated allele, and wherein the second RNA molecule targets a SNP in the same or a different exon of the mutated allele, a SNP in an intron, or a sequence in an intron present in both the mutated or functional allele.

According to embodiments of the present invention, the first RNA molecule or the first and the second RNA molecules target an alternative splicing signal sequence between an exon and an intron of a mutant allele.

According to embodiments of the present invention, the second RNA molecule targets a sequence present in both a mutated allele and a functional allele. According to embodiments of the present invention, the second RNA molecule targets an intron.

According to embodiments of the present invention, there is provided a method comprising subjecting the mutant allele to insertion or deletion by an error prone non-homologous end joining (NHEJ) mechanism, generating a frameshift in the mutated allele's sequence.

According to embodiments of the present invention, the frameshift results in inactivation or knockout of the mutated allele.

According to embodiments of the present invention, the frameshift creates an early stop codon in the mutated allele.

According to embodiments of the present invention, the frameshift results in nonsense-mediated mRNA decay of the transcript of the mutant allele.

According to embodiments of the present invention, the inactivating or treating results in a truncated protein encoded by the mutated allele and a functional protein encoded by the functional allele.

According to some embodiments of the present invention, there is provided use of a composition comprising an RNA molecule comprising a guide sequence portion having 17-20 nucleotides in the sequence of 17-20 contiguous nucleotides set forth in any one of SEQ ID NOs: 1-3010 and a CRISPR nuclease inactivating a mutant GUCY2D allele in a cell, comprising delivering to the cell the RNA molecule comprising a guide sequence portion having 17-20 nucleotides in the sequence of 17-20 contiguous nucleotides set forth in any one of SEQ ID NOs: 1-3010 and the CRISPR nuclease.

According to embodiments of the present invention, there is provided a medicament comprising an RNA molecule comprising a guide sequence portion having 17-20 nucleotides in the sequence of 17-20 contiguous nucleotides set forth in any one of SEQ ID NOs: 1-3010 and a CRISPR nuclease for use in inactivating a mutant GUCY2D allele in a cell, wherein the medicament is administered by delivering to the cell the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided use of a composition comprising an RNA molecule comprising a guide sequence portion having 17-20 nucleotides in the sequence of 17-20 contiguous nucleotides set forth in any one of SEQ ID NOs: 1-3010 and a CRISPR nuclease for treating ameliorating or preventing CORD, comprising delivering to a subject having or at risk of having CORD the composition of comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a medicament comprising the composition comprising an RNA molecule comprising a guide sequence portion having 17-20 nucleotides in the sequence of 17-20 contiguous nucleotides set forth in any one of SEQ ID NOs: 1-3010 and a CRISPR nuclease for use in treating ameliorating or preventing CORD, wherein the medicament is administered by delivering to a subject having or at risk of having CORD: the composition comprising an RNA molecule comprising a guide sequence portion having 17-20 nucleotides in the sequence of 17-20 contiguous nucleotides set forth in any one of SEQ ID NOs: 1-3010 and a CRISPR nuclease.

According to some embodiments of the present invention, there is provided a kit for inactivating a mutant GUCY2D allele in a cell, comprising an RNA molecule comprising a guide sequence portion having 17-20 nucleotides in the sequence of 17-20 contiguous nucleotides set forth in any one of SEQ ID NOs: 1-3010, a CRISPR nuclease, and/or a tracrRNA molecule; and instructions for delivering the RNA molecule; CRISPR nuclease, and/or the tracrRNA to the cell.

According to some embodiments of the present invention, there is provided a kit for treating CORD in a subject, comprising an RNA molecule comprising a guide sequence portion having 17-20 nucleotides in the sequence of 17-20 contiguous nucleotides set forth in any one of SEQ ID NOs: 1-3010, a CRISPR nuclease, and/or a tracrRNA molecule; and instructions for delivering the RNA molecule; CRISPR nuclease, and/or the tracrRNA to a subject having or at risk of having CORD.

In embodiments of the present invention, the RNA molecule comprises a guide sequence portion having 17-20 nucleotides in the sequence of 17-20 contiguous nucleotides set forth in any one of SEQ ID NOs: 1-742, SEQ ID NOs: 743-3010, or SEQ ID NOs 1-3010.

The compositions and methods of the present disclosure may be utilized for treating, preventing, ameliorating, or slowing progression of CORD.

In some embodiments, a mutated allele is deactivated by delivering to a cell an RNA molecule which targets a SNP in the promoter region, the start codon, or the untranslated region (UTR) of the mutated allele.

In some embodiments, a mutated allele is inactivated by removing at least a portion of the promoter and/or removing the start codon and/or a portion of the UTR. In some embodiments, the method of deactivating a mutated allele comprises removing at least a portion of the promoter. In such embodiments one RNA molecule may be designed for targeting a first SNP in the promoter or upstream to the promoter and another RNA molecule is designed to target a second SNP, which is downstream of the first SNP, and is in the promoter, in the UTR, or in an intron or in an exon. Alternatively, one RNA molecule may be designed for targeting a SNP in the promoter, or upstream of the promoter, or the UTR and another RNA molecule is designed to target a sequence which is present in an intron of both the mutated allele and the functional allele. Alternatively, one RNA molecule may be designed for targeting a sequence upstream of the promotor which is present in both the mutated and functional allele and the other guide is designed to target a SNP or disease-causing mutation in any location of the gene e.g., in an exon, intron, UTR, or downstream of the promoter.

In some embodiments, the method of deactivating a mutated allele comprises an exon skipping step comprising removing an exon containing a disease-causing mutation from the mutated allele. Removing an exon containing a disease-causing mutation in the mutated allele requires two RNA molecules which target regions flanking the entire exon or a portion of the exon. Removal of an exon containing the disease-causing mutation may be designed to eliminate the disease-causing action of the protein while allowing for expression of the remaining protein product which retains some or all of the wild-type activity. As an alternative to single exon skipping, multiple exons, the entire open reading frame or the entire gene can be excised using two RNA molecules flanking the region desired to be excised.

In some embodiments, the method of deactivating a mutated allele comprises delivering two RNA molecules to a cell, wherein one RNA molecule targets a SNP or disease-causing mutation in an exon or promoter of the mutated allele, and wherein the other RNA molecule targets a SNP in the same or a different exon of the mutated allele, a SNP in an intron, or a sequence in an intron present in both the mutated or functional allele.

In some embodiments, an RNA molecule is used to target a CRISPR nuclease to an alternative splicing signal sequence between an exon and an intron of a mutant allele, thereby destroying the alternative splicing signal sequence in the mutant allele.

Any one of, or combination of, the above-mentioned strategies for deactivating a mutant allele may be used in the context of the invention.

Additional strategies may be used to deactivate a mutated allele. For example, in embodiments of the present invention, an RNA molecule is used to direct a CRISPR nuclease to an exon or a splice site of a mutated allele in order to create a double-stranded break (DSB), leading to insertion or deletion of nucleotides by an error-prone non-homologous end-joining (NHEJ) mechanism and formation of a frameshift mutation in the mutated allele. The frameshift mutation may result in: (1) inactivation or knockout of the mutated allele by generation of an early stop codon in the mutated allele, resulting in generation of a truncated protein; or (2) nonsense mediated mRNA decay of the transcript of the mutant allele. In further embodiments, one RNA molecule is used to direct a CRISPR nuclease to a promotor of a mutated allele.

In some embodiments, the method of deactivating a mutated allele further comprises enhancing activity of the functional protein such as by providing a protein/peptide, a nucleic acid encoding a protein/peptide, or a small molecule such as a chemical compound, capable of activating/enhancing activity of the functional protein.

According to some embodiments, the present disclosure provides an RNA sequence (RNA molecule') which binds to/associates with and/or directs the RNA guided DNA nuclease e.g., CRISPR nuclease to a sequence comprising at least one nucleotide which differs between a mutated allele and a functional allele (e.g., SNP) of a gene of interest (i.e., a sequence of the mutated allele which is not present in the functional allele).

In some embodiments, the method comprises the steps of: contacting a mutated allele of a gene of interest with an allele-specific RNA molecule and a CRISPR nuclease e.g., a Cas9 protein, wherein the allele-specific RNA molecule and the CRISPR nuclease e.g., Cas9 associate with a nucleotide sequence of the mutated allele of the gene of interest which differs by at least one nucleotide from a nucleotide sequence of a functional allele of the gene of interest, thereby modifying or knocking-out the mutated allele.

In some embodiments, the allele-specific RNA molecule and a CRISPR nuclease is introduced to a cell encoding the gene of interest. In some embodiments, the cell encoding the gene of interest is in a mammalian subject. In some embodiments, the cell encoding the gene of interest is in a plant.

In some embodiments, the cleaved mutated allele is further subjected to insertion or deletion (indel) by an error prone non-homologous end joining (NHEJ) mechanism, generating a frameshift in the mutated allele's sequence. In some embodiments, the generated frameshift results in inactivation or knockout of the mutated allele. In some embodiments, the generated frameshift creates an early stop codon in the mutated allele and results in generation of a truncated protein. In such embodiments, the method results in the generation of a truncated protein encoded by the mutated allele and a functional protein encoded by the functional allele. In some embodiments, a frameshift generated in a mutated allele using the methods of the invention results in nonsense-mediated mRNA decay of the transcript of the mutant allele.

In some embodiments, the mutated allele is an allele of the GUCY2D gene. In some embodiments, the RNA molecule targets a SNP which co-exists with/is genetically linked to the mutated sequence associated with CORD genetic disorder. In some embodiments, the RNA molecule targets a SNP which is highly prevalent in the population and exists in the mutated allele having the mutated sequence associated with CORD genetic disorder and not in the functional allele of an individual subject to be treated. In some embodiments, a disease-causing mutation within a mutated GUCY2D allele is targeted.

In some embodiments, the SNP is within an exon of the gene of interest. In such embodiments, a guide sequence portion of an RNA molecule may be designed to associate with a sequence of the exon of the gene of interest.

In some embodiments, SNP is within an intron or an exon of the gene of interest. In some embodiments, SNP is in close proximity to a splice site between the intron and the exon. In some embodiments, the close proximity to a splice site is 1, 2, 3, 4, 5, 6, 7, 8, 9, 10, 11, 12, 13, 14, 15, 16, 17, 18, 19, or 20 nucleotides upstream or downstream to the splice site. Each possibility represents a separate embodiment of the present invention. In such embodiments, a guide sequence portion of an RNA molecule may be designed to associate with a sequence of the gene of interest which comprises the splice site.

In some embodiments, the method is utilized for treating a subject having a disease phenotype resulting from the heterozygote GUCY2D gene. In such embodiments, the method results in improvement, amelioration or prevention of the disease phenotype.

Embodiments referred to above refer to a CRISPR nuclease, RNA molecule(s), and tracrRNA being effective in a subject or cells at the same time. The CRISPR, RNA molecule(s), and tracrRNA can be delivered substantially at the same time or can be delivered at different times but have effect at the same time. For example, this includes delivering the CRISPR nuclease to the subject or cells before the RNA molecule and/or tracr RNA is substantially extant in the subject or cells.

In some embodiments, the cell is a retinal cell. In some embodiments, the cell is a photoreceptor cell. In some embodiments, the photoreceptor cell is a rod photoreceptor cell. In some embodiments, the photoreceptor cell is a cone photoreceptor cell.

Dominant Genetic Disorders.

One of skill in the art will appreciate that all subjects with any type of heterozygote genetic disorder (e.g., dominant genetic disorder) may be subjected to the methods described herein. In one embodiment, the present invention may be used to target a gene involved in, associated with, or causative of dominant genetic disorders such as, for example CORD. In some embodiments, the dominant genetic disorder is CORD In some embodiments, the target gene is the GUCY2D gene (Entrez Gene, gene ID No: 3000).

CRISPR Nucleases and PAM Recognition

In some embodiments, the sequence specific nuclease is selected from CRISPR nucleases, or a functional variant thereof. In some embodiments, the sequence specific nuclease is an RNA guided DNA nuclease. In such embodiments, the RNA sequence which guides the RNA guided DNA nuclease (e.g., Cpf1) binds to and/or directs the RNA guided DNA nuclease to the sequence comprising at least one nucleotide which differs between a mutated allele and its counterpart functional allele (e.g., SNP). In some embodiments, the CRISPR complex does not further comprise a tracrRNA. In a non-limiting example, in which the RNA guided DNA nuclease is a CRISPR protein, the at least one nucleotide which differs between the dominant mutated allele and the functional allele may be within the PAM site and/or proximal to the PAM site within the region that the RNA molecule is designed to hybridize to. A skilled artisan will appreciate that RNA molecules can be engineered to bind to a target of choice in a genome by commonly known methods in the art.

In embodiments of the present invention, a type II CRISPR system utilizes a mature crRNA:tracrRNA complex directs a CRISPR nuclease, e.g. Cas9, to the target DNA via Watson-Crick base-pairing between the crRNA and the protospacer on the target DNA next to the protospacer adjacent motif (PAM), an additional requirement for target recognition. The CRISPR nuclease then mediates cleavage of target DNA to create a double-stranded break within the protospacer. A skilled artisan will appreciate that each of the engineered RNA molecule of the present invention is further designed such as to associate with a target genomic DNA sequence of interest next to a protospacer adjacent motif (PAM), e.g., a PAM matching the sequence relevant for the type of CRISPR nuclease utilized, such as for a non-limiting example, NGG or NAG, wherein "N" is any nucleobase, for Streptococcus pyogenes Cas9 WT (SpCAS9); NNGRRT for Staphylococcus aureus (SaCas9); NNNVRYM for Jejuni Cas9 WT; NGAN or NGNG for SpCas9-VQR variant; NGCG for SpCas9-VRER variant; NGAG for SpCas9-EQR variant; NNNNGATT for *Neisseria meningitidis* (NmCas9); or TTTV for Cpf1. RNA molecules of the present invention are each designed to form complexes in conjunction with one or more different CRISPR nucleases and designed to target polynucleotide sequences of interest utilizing one or more different PAM sequences respective to the CRISPR nuclease utilized.

In some embodiments, an RNA-guided DNA nuclease e.g., a CRISPR nuclease, may be used to cause a DNA break at a desired location in the genome of a cell. The most commonly used RNA-guided DNA nucleases are derived from CRISPR systems, however, other RNA-guided DNA nucleases are also contemplated for use in the genome editing compositions and methods described herein. For instance, see U.S. Patent Publication No. 2015-0211023, incorporated herein by reference.

CRISPR systems that may be used in the practice of the invention vary greatly. CRISPR systems can be a type I, a type II, or a type III system. Non-limiting examples of suitable CRISPR proteins include Cas3, Cas4, Cas5, Cas5e (or CasD), Cas6, Cas6e, Cas6f, Cas7, Cas8a1, Cas8a2, Cas8b, Cas8c, Cas9, Cas10, Cas1 Od, CasF, CasG, CasH, Csy1 , Csy2, Csy3, Cse1 (or CasA), Cse2 (or CasB), Cse3 (or CasE), Cse4 (or CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3,Csx17, Csx14, Csx10, Csx16, CsaX, Csx3, Csz1, Csx15, Csf1, Csf2, Csf3, Csf4, and Cul966.

In some embodiments, the RNA-guided DNA nuclease is a CRISPR nuclease derived from a type II CRISPR system (e.g., Cas9). The CRISPR nuclease may be derived from *Streptococcus pyogenes, Streptococcus thermophilus, Streptococcus* sp., *Staphylococcus aureus, Neisseria meningitidis, Treponema denticola, Nocardiopsis dassonvillei, Streptomyces pristinaespiralis, Streptomyces viridochromogenes, Streptomyces viridochromogenes, Streptosporangium roseum, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Microscilla marina, Burkholderiales bacterium, Polaromonas naphthalenivorans, Polaromonas sp., Crocosphaera watsonii, Cyanothece sp., Microcystis aeruginosa, Synechococcus sp., Acetohalobium arabaticum, Ammonifex degensii, Caldicelulosiruptor becscii, Candidatus Desulforudis, Clostridium botulinum, Clostridium difficile, Finegoldia magna, Natranaerobius thermophilus, Pelotomaculumthermopropionicum, Acidithiobacillus caldus, Acidithiobacillus ferrooxidans, Allochromatium vinosum, Marinobacter sp., Nitrosococcus halophilus, Nitrosococcus watsoni, Pseudoalteromonas haloplanktis, Ktedonobacter racemifer, Methanohalobium evestigatum, Anabaena variabilis, Nodularia spumigena, Nostoc sp., Arthrospira maxima, Arthrospira platensis, Arthrospira sp., Lyngbya sp., Microcoleus chthonoplastes, Oscillatoria sp., Petrotoga mobilis, Thermosipho africanus, Acaryochloris marina*, or any species which encodes a CRISPR nuclease with a known PAM sequence. CRISPR nucleases encoded by uncultured bacteria may also be used in the context of the invention. (See Burstein et al. Nature, 2017). Variants of CRIPSR proteins having known PAM sequences e.g., spCas9 D1135E variant, spCas9 VQR variant, spCas9 EQR variant, or spCas9 VRER variant may also be used in the context of the invention.

Thus, an RNA guided DNA nuclease of a CRISPR system, such as a Cas9 protein or modified Cas9 or homolog or ortholog of Cas9, or other RNA guided DNA nucleases belonging to other types of CRISPR systems, such as Cpf1 and its homologs and orthologs, may be used in the compositions of the present invention.

In certain embodiments, the CRIPSR nuclease may be a "functional derivative" of a naturally occurring Cas protein. A "functional derivative" of a native sequence polypeptide is a compound having a qualitative biological property in common with a native sequence polypeptide. "Functional derivatives" include, but are not limited to, fragments of a native sequence and derivatives of a native sequence polypeptide and its fragments, provided that they have a biological activity in common with a corresponding native sequence polypeptide. A biological activity contemplated herein is the ability of the functional derivative to hydrolyze a DNA substrate into fragments. The term "derivative" encompasses both amino acid sequence variants of polypeptide, covalent modifications, and fusions thereof. Suitable derivatives of a Cas polypeptide or a fragment thereof include but are not limited to mutants, fusions, covalent modifications of Cas protein or a fragment thereof. Cas protein, which includes Cas protein or a fragment thereof, as well as derivatives of Cas protein or a fragment thereof, may be obtainable from a cell or synthesized chemically or by a combination of these two procedures. The cell may be a cell that naturally produces Cas protein, or a cell that naturally produces Cas protein and is genetically engineered to produce the endogenous Cas protein at a higher expression level or to produce a Cas protein from an exogenously introduced nucleic acid, which nucleic acid encodes a Cas that is same or different from the endogenous Cas. In some cases, the cell does not naturally produce Cas protein and is genetically engineered to produce a Cas protein.

In some embodiments, the CRISPR nuclease is Cpf1. Cpf1 is a single RNA-guided endonuclease which utilizes a T-rich protospacer-adjacent motif. Cpf1 cleaves DNA via a staggered DNA double-stranded break. Two Cpf1 enzymes from Acidaminococcus and Lachnospiraceae have been shown to carry out efficient genome-editing activity in human cells. (See Zetsche et al. (2015) Cell.).

Thus, an RNA guided DNA nuclease of a Type II CRISPR System, such as a Cas9 protein or modified Cas9 or homologs, orthologues, or variants of Cas9, or other RNA guided DNA nucleases belonging to other types of CRISPR systems, such as Cpf1 and its homologs, orthologues, or variants, may be used in the present invention.

In some embodiments, the guide molecule comprises one or more chemical modifications which imparts a new or improved property (e.g., improved stability from degradation, improved hybridization energetics, or improved binding properties with an RNA guided DNA nuclease). Suitable chemical modifications include, but are not limited to: modified bases, modified sugar moieties, or modified internucleoside linkages. Non-limiting examples of suitable chemical modifications include: 4-acetylcytidine, 5-(carboxyhydroxymethyl)uridine, 2'-O-methylcytidine, 5-carboxymethylaminomethyl-2-thiouridine, 5-carboxymethylaminomethyluridine, dihydrouridine, 2'-O-methylpseudouridine, "beta, D-galactosylqueuosine", 2'-O-methylguanosine, inosine, N6-isopentenyl adenosine, 1-methyladenosine, 1-methylpseudouridine, 1-methylguanosine, 1-methylinosine, "2,2-dimethylguanosine", 2-methyladenosine, 2-methylguanosine, 3-methylcytidine, 5-methylcytidine, N6-methyladenosine, 7-methylguanosine, 5-methylaminomethyluridine, methoxyaminomethyl-2-thiouridine, "beta, D-mannosylqueuosine", methoxycarbonylmethyl-2-thiouridine, 5-methoxycarbonylmethyluridine, 5-methoxyudridine, 2-methylthio-N6-isopentenyladenosine, N-((9-beta-D-ribofuranosyl-2-methylthiopurine-6-yl) carbamoyl)threonine, N-((9-beta-D-ribofuranosylpurine-6-yl)N-methylcarbamoyl)threonine, uridine-5-oxyacetic acid-methylester, uridine-5-oxyacetic acid, wybutoxosine, queuosine, 2-thiocytidine, 5-methyl-2-thiourdine, 2-thiouridine, 4-thiouridine, 5-methyluridine, N-((9-beta-D-ribofuranosylpurine-6-yl)-carbamoyl)threonine, 2'-O-methyl-5-methyluridine, 2'-O-methyluridine, wybutosine, "3-(3-amino-3-carboxy-propyl)uridine, (acp3)u", 2'-0-methyl (M), 3'-phosphorothioate (MS), 3'-thioPACE (MSP), pseudouridine, or 1-methyl pseudo-uridine. Each possibility represents a separate embodiment of the present invention.

Guide Sequences which Specifically Target a Mutant Allele

A given gene may contain thousands of SNPs. Utilizing a 24 base pair target window for targeting each SNP in a gene would require hundreds of thousands of guide sequences. Any given guide sequence when utilized to target a SNP may result in degradation of the guide sequence, limited activity, no activity, or off-target effects. Accordingly, suitable guide sequences are necessary for targeting a given gene. By the present invention, a novel set of guide sequences have been identified for knocking out expression of a mutated GUCY2D protein, inactivating a mutant GUCY2D gene allele, and treating CORD.

The present disclosure provides guide sequences capable of specifically targeting a mutated allele for inactivation while leaving the functional allele unmodified. The guide sequences of the present invention are designed to, and are most likely to, specifically differentiate between a mutated allele and a functional allele. Of all possible guide sequences which target a mutated allele desired to be inactivated, the specific guide sequences disclosed herein are specifically effective to function with the disclosed embodiments.

Briefly, the guide sequences may have properties as follows: (1) target SNP/insertion/deletion/indel with a high prevalence in the general population, in a specific ethnic population or in a patient population is above 1% and the SNP/insertion/deletion/indel heterozygosity rate in the same population is above 1%; (2) target a location of a SNP/insertion/deletion/indel proximal to a portion of the gene e.g., within 5 k bases of any portion of the gene, for example, a promoter, a UTR, an exon or an intron; and (3) target a mutant allele using an RNA molecule which targets a founder or common pathogenic mutations for the disease/gene. In some embodiments, the prevalence of the SNP/insertion/deletion/indel in the general population, in a specific ethnic population or in a patient population is above 1%, 2%, 3%, 4%, 5%, 6%, 7%, 8%, 9%, 10%, 11%, 12%, 13%, 14%, or 15% and the SNP/insertion/deletion/indel heterozygosity rate in the same population is above 1%, 2%, 3%, 4%, 5%, 6%, 7%, 8%, 9%, 10%, 11%, 12%, 13%, 14%, or 15%. Each possibility represents a separate embodiment and may be combined at will.

For each gene, according to SNP/insertion/deletion/indel any one of the following strategies may be used to deactivate the mutated allele: (1) Knockout strategy using one RNA molecule—one RNA molecule is utilized to direct a CRISPR nuclease to a mutated allele and create a double-strand break (DSB) leading to formation of a frameshift mutation in an exon or in a splice site region of the mutated allele; (2) Knockout strategy using two RNA molecules—two RNA molecules are utilized. A first RNA molecule targets a region in the promoter or an upstream region of a mutated allele and another RNA molecule targets downstream of the first RNA molecule in a promoter, exon, or intron of the mutated allele; (3) Exon(s) skipping strategy—one RNA molecule may be used to target a CRISPR nuclease to a splice site region, either at the 5' end of an intron (donor sequence) or the 3' end of an intron (acceptor sequence), in order to destroy the splice site. Alternatively, two RNA molecules may be utilized such that a first RNA molecule targets an upstream region of an exon and a second RNA molecule targets a region downstream of the first RNA molecule, thereby excising the exon(s). Based on the locations of identified SNPs/insertions/deletions/indels for each mutant allele, any one of, or a combination of, the above-mentioned methods to deactivate the mutant allele may be utilized.

When only one RNA molecule is used is that the location of the SNP is in an exon or in close proximity (e.g., within 20 basepairs) to a splice site between the intron and the exon. When two RNA molecules are used, guide sequences may target two SNPs such that the first SNP is upstream of exon 1 e.g., within the 5' untranslated region, or within the promoter or within the first 2 kilobases 5' of the transcription start site, and the second SNP is downstream of the first SNP e.g., within the first 2 kilobases 5' of the transcription start site, or within intron 1, 2 or 3, or within exon 1, exon 2, or exon 3.

Guide sequences of the present invention may target a SNP in the upstream portion of the targeted gene, preferably upstream of the last exon of the targeted gene. Guide sequences may target a SNP upstream to exon 1, for example within the 5' untranslated region, or within the promoter or within the first 4-5 kilobases 5' of the transcription start site.

Guide sequences of the present invention may also target a SNP within close proximity (e.g., within 50 basepairs, more preferably with 20 basepairs) to a known protospacer adjacent motif (PAM) site.

Guide sequences of the present invention also may target: (1) a heterozygous SNP for the targeted gene; (2) a heterozygous SNPs upstream and downstream of the gene; (3) a SNPs with a prevalence of the SNP/insertion/deletion/indel in the general population, in a specific ethnic population, or in a patient population above 1%; (4) have a guanine-cytosine content of greater than 30% and less than 85%; (5) have no repeat of 4 or more thymine/uracil or 8 or more guanine, cytosine, or adenine; (6) having no off-target identified by off-target analysis; and (7) preferably target Exons over Introns or be upstream of a SNP rather than downstream of a SNP.

In embodiments of the present invention, the SNP may be upstream or downstream of the gene. In embodiments of the present invention, the SNP is within 4,000 base pairs upstream or downstream of the gene.

The at least one nucleotide which differs between the mutated allele and the functional allele, may be upstream, downstream or within the sequence of the disease-causing mutation of the gene of interest. The at least one nucleotide which differs between the mutated allele and the functional allele, may be within an exon or within an intron of the gene of interest. In some embodiments, the at least one nucleotide which differs between the mutated allele and the functional allele is within an exon of the gene of interest. In some embodiments, the at least one nucleotide which differs between the mutated allele and the functional allele is within an intron or an exon of the gene of interest, in close proximity to a splice site between the intron and the exon e.g., 1, 2, 3, 4, 5, 6, 7, 8, 9, 10, 11, 12, 13, 14, 15, 16, 17, 18, 19, or 20 nucleotides upstream or downstream to the splice site.

In some embodiments, the at least one nucleotide is a single nucleotide polymorphisms (SNPs). In some embodiments, each of the nucleotide variants of the SNP may be expressed in the mutated allele. In some embodiments, the SNP may be a founder or common pathogenic mutation. Guide sequences may target a SNP which has both (1) a high prevalence in the general population e.g., above 1% in the population; and (2) a high heterozygosity rate in the population, e.g., above 1%. Guide sequences may target a SNP that is globally distributed. A SNP may be a founder or common pathogenic mutation. In some embodiments, the prevalence in the general population is above 1%, 2%, 3%, 4%, 5%, 6%, 7%, 8%, 9%, 10%, 11%, 12%, 13%, 14%, or 15%. Each possibility represents a separate embodiment. In some embodiments, the heterozygosity rate in the population is above 1%, 2%, 3%, 4%, 5%, 6%, 7%, 8%, 9%, 10%, 11%, 12%, 13%, 14%, or 15%. Each possibility represents a separate embodiment.

In some embodiments, the at least one nucleotide which differs between the mutated allele and the functional allele is linked to/co-exists with the disease-causing mutation in high prevalence in a population. In such embodiments, "high prevalence" refers to at least 92%, 93%, 94%, 95%, 96%, 97%, 98%, 99%, or 100%. Each possibility represents a separate embodiment of the present invention. In one embodiment, the at least one nucleotide which differs between the mutated allele and the functional allele, is a disease-associated mutation. In some embodiments, the SNP is highly prevalent in the population. In such embodiments, "highly prevalent" refers to at least 10%, 11%, 12%, 13%, 14%, 15%, 20%, 30%, 40%, 50%, 60%, or 70% of a population. Each possibility represents a separate embodiment of the present invention.

Guide sequences of the present invention may satisfy any one of the above criteria and are most likely to differentiate between a mutated allele from its corresponding functional allele.

In some embodiments the RNA molecule targets a SNP/WT sequence linked to SNPs as shown in Table 1 below. The SNP details are indicated in the 1$^{st}$ column and include: SNP ID No. (based on NCBI's 2018 database of Single Nucleotide Polymorphisms (dbSNP)). For variants with no available rs number variants characteristic are indicated based on gnomAD 2018 browser database. The 2$^{nd}$ column indicates an assigned identifier for each SNP. The 3$^{rd}$ column indicates the location of each SNP on the GUCY2D gene.

TABLE 1

GUCY2D gene SNPs

| RSID | SNP No. | SNP location in the gene |
| --- | --- | --- |
| rs761913009 | s1 | Intron_19 of 19 |
| 17:7923438_C_T | s2 | Intron_19 of 19 |
| 17:7923435_C_T | s3 | Intron_19 of 19 |
| 17:7923434_G_T | s4 | Intron_19 of 19 |
| rs56300556 | s5 | downstream +1113 bp |
| rs867805871 | s6 | downstream +1112 bp |
| rs760500680 | s7 | downstream +1106 bp |
| rs3813585 | s8 | Intron_14 of 19 |
| rs7503918 | s9 | Intron_19 of 19 |
| rs4791456 | s10 | downstream +203 bp |
| rs9889612 | s11 | upstream −1603 bp |
| rs11655487 | s12 | Intron_12 of 19 |
| rs7501868 | s13 | Intron_19 of 19 |
| rs4792111 | s14 | Intron_19 of 19 |
| rs7501530 | s15 | upstream −2377 bp |
| rs61749665 | s16 | Exon_2 of 20 |
| rs12103521 | s17 | Intron_19 of 19 |
| rs2816 | s18 | Exon_20 of 20 |
| rs8069344 | s19 | Exon_12 of 20 |
| rs12103519 | s20 | Intron_19 of 19 |
| rs8071166 | s21 | Intron_19 of 19 |
| rs72841478 | s22 | Intron_3 of 19 |
| rs11655691 | s23 | Intron_19 of 19 |
| rs56130505 | s24 | Exon_10 of 20 |
| rs3829789 | s25 | Exon_3 of 20 |
| rs34922798 | s26 | Intron_8 of 19 |
| rs9905402 | s27 | Exon_2 of 20 |
| rs72841482 | s28 | Intron_13 of 19 |
| rs8068722 | s29 | Intron_13 of 19 |
| rs73237655 | s30 | Intron_7 of 19 |
| rs9914686 | s31 | Intron_3 of 19 |
| rs12449814 | s32 | Intron_7 of 19 |
| rs73237639 | s33 | upstream −3180 bp |
| rs9903069 | s34 | upstream −2486 bp |
| 17:7906016_C_T | s35 | Exon_1 of 20 |
| rs34598902 | s36 | Exon_10 of 20 |
| rs57490393 | s37 | downstream +1088 bp |
| rs57307096 | s38 | downstream +1090 bp |
| rs12103471 | s39 | Intron_13 of 19 |
| rs80076597 | s40 | Intron_19 of 19 |
| rs56348143 | s41 | Intron_16 of 19 |
| rs60130989 | s42 | Intron_10 of 19 |
| rs57477973 | s43 | downstream +2441 bp |
| rs58765638 | s44 | downstream +2669 bp |
| rs112984002 | s45 | Intron_5 of 19 |
| rs73978653 | s46 | Intron_7 of 19 |
| rs142351773 | s47 | Exon_19 of 20 |
| rs116870332 | s48 | Intron_16 of 19 |
| rs138596240 | s49 | Exon_20 of 20 |
| rs56034424 | s50 | Exon_4 of 20 |
| rs139731548 | s51 | Intron_9 of 19 |
| rs79887212 | s52 | Intron_18 of 19 |
| rs74656480 | s53 | Intron_19 of 19 |
| rs78901930 | s54 | Exon_20 of 20 |
| rs73978656 | s55 | Intron_19 of 19 |
| rs73978658 | s56 | Intron_19 of 19 |
| rs73978654 | s57 | Intron_19 of 19 |
| rs4791452 | s58 | Intron_7 of 19 |
| rs57184071 | s59 | Intron_8 of 19 |
| rs72841481 | s60 | Intron_11 of 19 |
| rs80245692 | s61 | Intron_5 of 19 |
| rs28743021 | s62 | Exon_8 of 20 |
| rs78844078 | s63 | Intron_16 of 19 |
| rs78380494 | s64 | Intron_19 of 19 |
| rs56316238 | s65 | Exon_13 of 20 |
| rs73978655 | s66 | Intron_19 of 19 |
| rs2534 | s67 | Intron_8 of 19 |
| rs75290069 | s68 | Intron_3 of 19 |
| rs34594470 | s69 | Intron_8 of 19 |
| rs9891219 | s70 | Intron_8 of 19 |
| rs6503069 | s71 | downstream +1197 bp |
| rs34898068 | s72 | upstream −2657 bp |
| rs67594392 | s73 | Intron_19 of 19 |
| rs9901134 | s74 | upstream −3866 bp |
| rs79016382 | s75 | downstream +3155 bp |
| rs149260011 | s76 | Intron_8 of 19 |

Delivery to Cells

The RNA molecule compositions described herein may be delivered to a target cell by any suitable means. RNA molecule compositions of the present invention may be targeted to any cell which contains and/or expresses a dominant negative allele, including any mammalian or plant cell. For example, in one embodiment the RNA molecule specifically targets a mutated GUCY2D allele and the target cell is a retinal cell such as pigment epithelium (RPE), photoreceptors (e.g., rod and cone), glial cells (e.g., Müller), and ganglion cells. Further, the nucleic acid compositions described herein may be delivered as one or more DNA molecules, RNA molecules, Ribonucleoproteins (RNP), nucleic acid vectors, or any combination thereof.

In some embodiments, the RNA molecule comprises a chemical modification. Non-limiting examples of suitable chemical modifications include 2'-0-methyl (M), 2'-0-methyl, 3'phosphorothioate (MS) or 2'-0-methyl, 3'thio-PACE (MSP), pseudouridine, and 1-methyl pseudo-uridine. Each possibility represents a separate embodiment of the present invention.

Any suitable viral vector system may be used to deliver nucleic acid compositions e.g., the RNA molecule compositions of the subject invention. Conventional viral and non-viral based gene transfer methods can be used to introduce nucleic acids and target tissues. In certain embodiments, nucleic acids are administered for in vivo or ex vivo gene therapy uses. Non-viral vector delivery systems include naked nucleic acid, and nucleic acid complexed with a delivery vehicle such as a liposome or poloxamer. For a review of gene therapy procedures, see Anderson (1992) Science 256:808-813; Nabel & Felgner (1993) TIBTECH 11:211-217; Mitani & Caskey (1993) TIBTECH 11:162-166; Dillon (1993) TIBTECH 11:167-175; Miller (1992) Nature 357:455-460; Van Brunt (1988) Biotechnology 6(10):1149-1154; Vigne (1995) Restorative Neurology and Neuroscience 8:35-36; Kremer & Perricaudet (1995) British Medical Bulletin 51(1):31-44; Haddada et al. (1995) in Current Topics in Microbiology and Immunology Doerfler and Bohm (eds.); and Yu et al. (1994) Gene Therapy 1:13-26.

Methods of non-viral delivery of nucleic acids and/or proteins include electroporation, lipofection, microinjection, biolistics, particle gun acceleration, virosomes, liposomes, immunoliposomes, lipid nanoparticles (LNPs), polycation or lipid:nucleic acid conjugates, artificial virions, and agent-enhanced uptake of nucleic acids or can be delivered to plant cells by bacteria or viruses (e.g., *Agrobacterium, Rhizobium* sp. NGR234, Sinorhizoboiummeliloti, Mesorhizobium loti, tobacco mosaic virus, potato virus X, cauliflower mosaic virus and cassava vein mosaic virus). (See, e.g., Chung et al. (2006) Trends Plant Sci. 11(1):1-4). Sonoporation using, e.g., the Sonitron 2000 system (Rich-Mar), can also be used for delivery of nucleic acids. Cationic-lipid mediated delivery of proteins and/or nucleic acids is also contemplated as an in vivo or in vitro delivery method. (See Zuris et al. (2015) Nat. Biotechnol. 33(1):73-80; see also Coelho et al. (2013) N. Engl. J. Med. 369, 819-829; Judge et al. (2006) Mol. Ther. 13, 494-505; and Basha et al. (2011) Mol. Ther. 19, 2186-2200).

Additional exemplary nucleic acid delivery systems include those provided by Amaxa.RTM. Biosystems (Cologne, Germany), Maxcyte, Inc. (Rockville, Md.), BTX Molecular Delivery Systems (Holliston, Mass.) and Copernicus Therapeutics Inc., (see, e.g., U.S. Pat. No. 6,008,336). Lipofection is described in e.g., U.S. Pat. No. 5,049,386, U.S. Pat. No. 4,946,787; and U.S. Pat. No. 4,897,355, and lipofection reagents are sold commercially (e.g., Transfectam™, Lipofectin™ and Lipofectamine™ RNAiMAX). Cationic and neutral lipids that are suitable for efficient receptor-recognition lipofection of polynucleotides include those of Felgner, WO 91/17424, WO 91/16024. Delivery can be to cells (ex vivo administration) or target tissues (in vivo administration).

The preparation of lipid:nucleic acid complexes, including targeted liposomes such as immunolipid complexes, is well known to one of skill in the art (See, e.g., Crystal (1995) Science 270:404-410; Blaese et al. (1995) Cancer Gene Ther. 2:291-297; Behr et al. (1994) Bioconjugate Chem. 5:382-389; Remy et al. (1994) Bioconjugate Chem. 5:647-654; Gao et al. (1995) Gene Therapy 2:710-722; Ahmad et al. (1992) Cancer Res. 52:4817-4820; U.S. Pat. Nos. 4,186,183, 4,217,344, 4,235,871, 4,261,975, 4,485,054, 4,501,728, 4,774,085, 4,837,028, and 4,946,787).

Additional methods of delivery include the use of packaging the nucleic acids to be delivered into EnGeneIC delivery vehicles (EDVs). These EDVs are specifically delivered to target tissues using bispecific antibodies where one arm of the antibody has specificity for the target tissue and the other has specificity for the EDV. The antibody brings the EDVs to the target cell surface and then the EDV is brought into the cell by endocytosis. Once in the cell, the contents are released (See MacDiarmid et al (2009) Nature Biotechnology 27(7):643).

The use of RNA or DNA viral based systems for viral mediated delivery of nucleic acids take advantage of highly evolved processes for targeting a virus to specific cells in the body and trafficking the viral payload to the nucleus. Viral vectors can be administered directly to patients (in vivo) or they can be used to treat cells in vitro and the modified cells are administered to patients (ex vivo). Conventional viral based systems for the delivery of nucleic acids include, but are not limited to, retroviral, lentivirus, adenoviral, adeno-associated, vaccinia and herpes simplex virus vectors for gene transfer.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system depends on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immunodeficiency virus (SIV), human immunodeficiency virus (HIV), and combinations thereof (See, e.g., Buchschacher et al. (1992) J. Virol. 66:2731-2739; Johann et al. (1992) J. Virol. 66:1635-1640; Sommerfelt et al. (1990) Virol. 176:58-59; Wilson et al. (1989) J. Virol. 63:2374-2378; Miller et al. (1991) J. Virol. 65:2220-2224; PCT/US94/05700).

At least six viral vector approaches are currently available for gene transfer in clinical trials, which utilize approaches that involve complementation of defective vectors by genes inserted into helper cell lines to generate the transducing agent.

pLASN and MFG-S are examples of retroviral vectors that have been used in clinical trials (Dunbar et al. (1995) Blood 85:3048-305; Kohn et al.(1995) Nat. Med. 1:1017-102; Malech et al. (1997) PNAS 94:22 12133-12138). PA317/pLASN was the first therapeutic vector used in a gene therapy trial. (Blaese et al. (1995). Transduction efficiencies of 50% or greater have been observed for MFG-S packaged vectors. (Ellem et al. (1997) Immunol Immunother. 44(1):10-20; Dranoff et al. (1997) Hum. Gene Ther. 1:111-2).

Packaging cells are used to form virus particles that are capable of infecting a host cell. Such cells include 293 cells, which package adenovirus, AAV, and Psi-2 cells or PA317 cells, which package retrovirus. Viral vectors used in gene therapy are usually generated by a producer cell line that packages a nucleic acid vector into a viral particle. The vectors typically contain the minimal viral sequences required for packaging and subsequent integration into a host (if applicable), other viral sequences being replaced by an expression cassette encoding the protein to be expressed. The missing viral functions are supplied in trans by the packaging cell line. For example, AAV vectors used in gene therapy typically only possess inverted terminal repeat (ITR) sequences from the AAV genome which are required for packaging and integration into the host genome. Viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additionally, AAV can be produced at clinical scale using baculovirus systems (see U.S. Pat. No. 7,479,554).

In many gene therapy applications, it is desirable that the gene therapy vector be delivered with a high degree of specificity to a particular tissue type. Accordingly, a viral vector can be modified to have specificity for a given cell type by expressing a ligand as a fusion protein with a viral coat protein on the outer surface of the virus. The ligand is chosen to have affinity for a receptor known to be present on the cell type of interest. For example, Han et al. (1995) Proc. Natl. Acad. Sci. USA 92:9747-9751, reported that Moloney murine leukemia virus can be modified to express human heregulin fused to gp70, and the recombinant virus infects certain human breast cancer cells expressing human epidermal growth factor receptor. This principle can be extended to other virus-target cell pairs, in which the target cell expresses a receptor and the virus expresses a fusion protein comprising a ligand for the cell-surface receptor. For example, filamentous phage can be engineered to display antibody fragments (e.g., FAB or Fv) having specific binding affinity for virtually any chosen cellular receptor. Although the above description applies primarily to viral vectors, the same principles can be applied to nonviral vectors. Such vectors can be engineered to contain specific uptake sequences which favor uptake by specific target cells.

Gene therapy vectors can be delivered in vivo by administration to an individual patient, typically by systemic administration (e.g., intravitreal, intravenous, intraperitoneal, intramuscular, subdermal, or intracranial infusion) or topical application, as described below. Alternatively, vectors can be delivered to cells ex vivo, such as cells explanted from an individual patient (e.g., lymphocytes, bone marrow aspirates, tissue biopsy) or universal donor hematopoietic stem cells, followed by reimplantation of the cells into a patient, usually after selection for cells which have incorporated the vector.

Ex vivo cell transfection for diagnostics, research, or for gene therapy (e.g., via re-infusion of the transfected cells into the host organism) is well known to those of skill in the art. In a preferred embodiment, cells are isolated from the subject organism, transfected with a nucleic acid composition, and re-infused back into the subject organism (e.g., patient). Various cell types suitable for ex vivo transfection are well known to those of skill in the art (See, e.g., Freshney et al. (1994) Culture of Animal Cells, A Manual of Basic Technique, 3rd ed, and the references cited therein for a discussion of how to isolate and culture cells from patients).

Suitable cells include, but are not limited to, eukaryotic cells and/or cell lines. Non-limiting examples of such cells or cell lines generated from such cells include COS, CHO (e.g., CHO—S, CHO-K1, CHO-DG44, CHO-DUXB11, CHO-DUKX, CHOK1SV), VERO, MDCK, WI38, V79, B14AF28-G3, BHK, HaK, NSO, SP2/0-Ag14, HeLa, HEK293 (e.g., HEK293-F, HEK293-H, HEK293-T), perC6 cells, any plant cell (differentiated or undifferentiated), as well as insect cells such as Spodopterafugiperda (Sf), or fungal cells such as *Saccharomyces, Pichia* and *Schizosaccharomyces*. In certain embodiments, the cell line is a CHO-K1, MDCK or HEK293 cell line. Additionally, primary cells may be isolated and used ex vivo for reintroduction into the subject to be treated following treatment with a guided nuclease system (e.g. CRISPR/Cas). Suitable primary cells include peripheral blood mononuclear cells (PBMC), and other blood cell subsets such as, but not limited to, CD4+ T cells or CD8+ T cells. Suitable cells also include stem cells such as, by way of example, embryonic stem cells, induced pluripotent stem cells, hematopoietic stem cells (CD34+), neuronal stem cells and mesenchymal stem cells.

In one embodiment, stem cells are used in ex vivo procedures for cell transfection and gene therapy. The advantage to using stem cells is that they can be differentiated into other cell types in vitro, or can be introduced into a mammal (such as the donor of the cells) where they will engraft in the bone marrow. Methods for differentiating CD34+ cells in vitro into clinically important immune cell types using cytokines such a GM-CSF, IFN-gamma, and TNF-alpha are known (as a non-limiting example see, Inaba et al., J. Exp. Med. 176:1693-1702 (1992)). Stem cells are isolated for transduction and differentiation using known methods. For example, stem cells are isolated from bone marrow cells by panning the bone marrow cells with antibodies which bind unwanted cells, such as CD4+ and CD8+ (T cells), CD45+ (panB cells), GR-1 (granulocytes), and Tad (differentiated antigen presenting cells) (as a non-limiting example see Inaba et al. (1992) J. Exp. Med. 176:1693-1702). Stem cells that have been modified may also be used in some embodiments.

Any one of the RNA molecule compositions described herein is suitable for genome editing in post-mitotic cells or any cell which is not actively dividing, e.g., arrested cells. Examples of post-mitotic cells which may be edited using a composition of the present invention include, but are not limited to, a photoreceptor cell, a rod photoreceptor cell, a cone photoreceptor cell, a retinal pigment epithelium (RPE), a glial cell, Muller cell, and a ganglion.

Vectors (e.g., retroviruses, liposomes, etc.) containing therapeutic nucleic acid compositions can also be administered directly to an organism for transduction of cells in vivo. Administration is by any of the routes normally used for introducing a molecule into ultimate contact with blood or tissue cells including, but not limited to, injection, infusion, topical application (e.g., eye drops and cream) and electroporation. Suitable methods of administering such nucleic acids are available and well known to those of skill in the art, and, although more than one route can be used to administer a particular composition, a particular route can often provide a more immediate and more effective reaction than another route. According to some embodiments, the composition is delivered via sub-retinal injection. According to some embodiments, the composition is delivered via intravitreal injection.

Vectors suitable for introduction of transgenes into immune cells (e.g., T-cells) include non-integrating lentivirus vectors. See, e.g., U.S. Patent Publication No. 2009-0117617.

Pharmaceutically acceptable carriers are determined in part by the particular composition being administered, as well as by the particular method used to administer the composition. Accordingly, there is a wide variety of suitable formulations of pharmaceutical compositions available, as described below (See, e.g., Remington's Pharmaceutical Sciences, 17th ed., 1989).

In accordance with some embodiments, there is provided an RNA molecule which binds to associates with and/or directs the RNA guided DNA nuclease to a sequence comprising at least one nucleotide which differs between a mutated allele and a functional allele (e.g., SNP) of a gene of interest (i.e., a sequence of the mutated allele which is not present in the functional allele). The sequence may be within the disease associated mutation. The sequence may be upstream or downstream to the disease associated mutation. Any sequence difference between the mutated allele and the functional allele may be targeted by an RNA molecule of the present invention to inactivate the mutant allele, or otherwise disable its dominant disease-causing effects, while preserving the activity of the functional allele.

The disclosed compositions and methods may also be used in the manufacture of a medicament for treating dominant genetic disorders in a patient.

Examples of RNA Guide Sequences which Specifically Target Mutated Alleles of GUCY2D Gene Although a large number of guide sequences can be designed to target a mutated allele, the nucleotide sequences described in Tables 2 identified by SEQ ID NOs: 1-3010 below were specifically selected to effectively implement the methods set forth herein and to effectively discriminate between alleles.

Referring to columns 1-4, each of SEQ ID NOs. 1-3010 indicated in column 1 corresponds to an engineered guide sequence. The corresponding SNP details are indicated in column 2. The SNP details indicated in the 2nd column include the assigned identifier for each SNP corresponding to a SNP ID indicated in Table 1. Column 3 indicates whether the target of each guide sequence is the GUCY2D gene polymorph or wild type (REF) sequence. Column 4 indicates the guanine-cytosine content of each guide sequence.

Table 2 shows guide sequences designed for use as described in the embodiments above to associate with different SNPs within a sequence of a mutated GUCY2D allele. Each engineered guide molecule is further designed such as to associate with a target genomic DNA sequence of interest that lies next to a protospacer adjacent motif (PAM), e.g., a PAM matching the sequence NGG or NAG, where "N" is any nucleobase. The guide sequences were designed to work in conjunction with one or more different CRISPR nucleases, including, but not limited to, e.g. SpCas9WT (PAM SEQ: NGG), SpCas9.VQR.1 (PAM SEQ: NGAN), SpCas9.VQR.2 (PAM SEQ: NGNG), SpCas9.EQR (PAM SEQ: NGAG), SpCas9.VRER (PAM SEQ: NGCG), SaCas9WT (PAM SEQ: NNGRRT), NmCas9WT (PAM SEQ: NNNNGATT), Cpf1(PAM SEQ: TTTV), or JeCas9WT (PAM SEQ: NNNVRYM). RNA molecules of the present invention are each designed to form complexes in conjunction with one or more different CRISPR nucleases and designed to target polynucleotide sequences of interest utilizing one or more different PAM sequences respective to the CRISPR nuclease utilized

TABLE 2

Guide sequences designed to associate with specific SNPs of the GUCY2D gene

| SEQ ID NO: | SNP ID (Table 1) | Target (SNP/REF) | % GC |
|---|---|---|---|
| 1 | s1, s2, s3, s4 | REF, REF, REF, REF | 50% |
| 2 | s1, s2, s3, s4 | REF, REF, REF, REF | 50% |
| 3 | s1, s2, s3, s4 | REF, REF, REF, REF | 45% |
| 4 | s8 | BOTH | 40% |
| 5 | s8 | BOTH | 45% |
| 6 | s8 | BOTH | 40% |
| 7 | s9 | BOTH | 50% |
| 8 | s9 | BOTH | 55% |
| 9 | s9 | BOTH | 55% |
| 10 | s9 | BOTH | 45% |
| 11 | s11 | BOTH | 45% |
| 12 | s11 | BOTH | 45% |
| 13 | s12 | BOTH | 60% |
| 14 | s12 | BOTH | 50% |
| 15 | s15 | BOTH | 35% |
| 16 | s16 | BOTH | 65% |
| 17 | s16 | BOTH | 70% |
| 18 | s17 | BOTH | 65% |
| 19 | s17 | BOTH | 65% |
| 20 | s18 | BOTH | 60% |
| 21 | s20 | BOTH | 70% |
| 22 | s20 | BOTH | 70% |
| 23 | s21 | BOTH | 50% |
| 24 | s21 | BOTH | 65% |
| 25 | s21 | BOTH | 45% |
| 26 | s22 | BOTH | 45% |
| 27 | s22 | BOTH | 45% |
| 28 | s23 | BOTH | 60% |
| 29 | s23 | BOTH | 70% |
| 30 | s25 | BOTH | 75% |
| 31 | s25 | BOTH | 70% |
| 32 | s25 | BOTH | 70% |
| 33 | s27 | BOTH | 85% |
| 34 | s27 | BOTH | 85% |
| 35 | s27 | BOTH | 80% |
| 36 | s31 | BOTH | 55% |
| 37 | s32 | BOTH | 60% |
| 38 | s32 | BOTH | 70% |
| 39 | s33 | BOTH | 35% |
| 40 | s33 | BOTH | 40% |
| 41 | s34 | BOTH | 45% |
| 42 | s35 | BOTH | 90% |
| 43 | s35 | BOTH | 90% |
| 44 | s35 | BOTH | 80% |
| 45 | s36, s24 | REF, BOTH | 70% |
| 46 | s36, s24 | REF, BOTH | 70% |
| 47 | s36, s24 | REF, BOTH | 70% |
| 48 | s36, s24 | REF, REF | 75% |
| 49 | s36, s24 | REF, REF | 70% |
| 50 | s36, s24 | REF, REF | 75% |
| 51 | s36, s24 | REF, REF | 75% |
| 52 | s36, s24 | REF, REF | 75% |
| 53 | s36, s24 | REF, REF | 65% |
| 54 | s36, s24 | REF, REF | 70% |
| 55 | s36, s24 | REF, REF | 70% |
| 56 | s36, s24 | REF, REF | 70% |
| 57 | s36, s24 | REF, REF | 75% |
| 58 | s36, s24 | BOTH, REF | 60% |
| 59 | s36, s24 | BOTH, REF | 60% |
| 60 | s36, s24 | BOTH, REF | 65% |
| 61 | s29, s39 | REF, BOTH | 65% |
| 62 | s29, s39 | REF, REF | 70% |
| 63 | s29, s39 | REF, REF | 70% |
| 64 | s41 | BOTH | 55% |
| 65 | s41 | BOTH | 75% |
| 66 | s41 | BOTH | 60% |
| 67 | s42 | BOTH | 80% |
| 68 | s42 | BOTH | 60% |
| 69 | s42 | BOTH | 80% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 70 | s42 | BOTH | 75% |
| 71 | s2, s3, s4 | REF, BOTH, BOTH | 65% |
| 72 | s2, s3, s4 | REF, BOTH, BOTH | 65% |
| 73 | s2 | BOTH | 65% |
| 74 | s2 | BOTH | 70% |
| 75 | s45 | BOTH | 45% |
| 76 | s46 | BOTH | 60% |
| 77 | s46 | BOTH | 65% |
| 78 | s46 | BOTH | 55% |
| 79 | s47 | BOTH | 70% |
| 80 | s47 | BOTH | 50% |
| 81 | s47 | BOTH | 70% |
| 82 | s47 | BOTH | 70% |
| 83 | s47 | BOTH | 45% |
| 84 | s48 | BOTH | 65% |
| 85 | s49 | BOTH | 60% |
| 86 | s50 | BOTH | 70% |
| 87 | s50 | BOTH | 75% |
| 88 | s52 | BOTH | 65% |
| 89 | s52 | BOTH | 60% |
| 90 | s53 | BOTH | 50% |
| 91 | s53 | BOTH | 45% |
| 92 | s54 | BOTH | 55% |
| 93 | s54 | BOTH | 55% |
| 94 | s54 | BOTH | 55% |
| 95 | s55 | BOTH | 45% |
| 96 | s55 | BOTH | 50% |
| 97 | s56 | BOTH | 55% |
| 98 | s56 | BOTH | 65% |
| 99 | s56 | BOTH | 50% |
| 100 | s56 | BOTH | 65% |
| 101 | s57 | BOTH | 65% |
| 102 | s57 | BOTH | 45% |
| 103 | s58 | BOTH | 45% |
| 104 | s58 | BOTH | 40% |
| 105 | s59 | BOTH | 50% |
| 106 | s61 | BOTH | 55% |
| 107 | s61 | BOTH | 50% |
| 108 | s62 | BOTH | 55% |
| 109 | s62 | BOTH | 60% |
| 110 | s62 | BOTH | 50% |
| 111 | s63, s48 | REF, BOTH | 70% |
| 112 | s63, s48 | BOTH, REF | 65% |
| 113 | s63, s48 | REF, REF | 70% |
| 114 | s63, s48 | REF, REF | 60% |
| 115 | s63, s48 | REF, REF | 65% |
| 116 | s63, s48 | REF, REF | 70% |
| 117 | s63, s48 | REF, REF | 60% |
| 118 | s63, s48 | REF, REF | 70% |
| 119 | s63, s48 | REF, REF | 65% |
| 120 | s63, s48 | REF, REF | 55% |
| 121 | s63, s48 | REF, REF | 65% |
| 122 | s63, s48 | REF, REF | 55% |
| 123 | s63 | BOTH | 75% |
| 124 | s64, s17 | BOTH, REF | 45% |
| 125 | s64, s17 | REF, REF | 40% |
| 126 | s64, s17 | REF, REF | 45% |
| 127 | s64, s17 | REF, REF | 40% |
| 128 | s64, s17 | REF, REF | 40% |
| 129 | s64 | BOTH | 70% |
| 130 | s65 | BOTH | 65% |
| 131 | s65 | BOTH | 65% |
| 132 | s66 | BOTH | 65% |
| 133 | s67 | BOTH | 55% |
| 134 | s67 | BOTH | 40% |
| 135 | s67 | BOTH | 35% |
| 136 | s68 | BOTH | 35% |
| 137 | s68 | BOTH | 40% |
| 138 | s1 | SNP | 45% |
| 139 | s8 | REF | 45% |
| 140 | s8 | SNP | 50% |
| 141 | s8 | REF | 50% |
| 142 | s8 | SNP | 55% |
| 143 | s8 | SNP | 55% |
| 144 | s8 | REF | 40% |
| 145 | s8 | SNP | 45% |
| 146 | s8 | SNP | 65% |
| 147 | s8 | REF | 55% |
| 148 | s8 | SNP | 60% |
| 149 | s8 | REF | 40% |
| 150 | s8 | REF | 45% |
| 151 | s8 | SNP | 50% |
| 152 | s8 | SNP | 45% |
| 153 | s8 | REF | 40% |
| 154 | s9 | REF | 65% |
| 155 | s9 | SNP | 60% |
| 156 | s9 | REF | 60% |
| 157 | s9 | SNP | 55% |
| 158 | s9 | SNP | 60% |
| 159 | s9 | REF | 65% |
| 160 | s9 | REF | 70% |
| 161 | s9 | SNP | 65% |
| 162 | s9 | SNP | 60% |
| 163 | s9 | REF | 65% |
| 164 | s9 | SNP | 60% |
| 165 | s9 | REF | 65% |
| 166 | s9 | REF | 60% |
| 167 | s9 | SNP | 55% |
| 168 | s9 | REF | 65% |
| 169 | s9 | SNP | 60% |
| 170 | s9 | SNP | 60% |
| 171 | s9 | REF | 65% |
| 172 | s9 | SNP | 55% |
| 173 | s9 | REF | 60% |
| 174 | s9 | SNP | 55% |
| 175 | s9 | REF | 60% |
| 176 | s9 | SNP | 55% |
| 177 | s9 | REF | 60% |
| 178 | s9 | SNP | 55% |
| 179 | s9 | REF | 60% |
| 180 | s9 | SNP | 50% |
| 181 | s9 | REF | 55% |
| 182 | s70 | REF | 60% |
| 183 | s70 | SNP | 60% |
| 184 | s70 | SNP | 70% |
| 185 | s70 | SNP | 55% |
| 186 | s11 | SNP | 40% |
| 187 | s11 | REF | 35% |
| 188 | s11 | SNP | 50% |
| 189 | s11 | REF | 45% |
| 190 | s11 | REF | 40% |
| 191 | s11 | SNP | 45% |
| 192 | s11 | SNP | 35% |
| 193 | s11 | SNP | 35% |
| 194 | s12 | REF | 35% |
| 195 | s12 | SNP | 50% |
| 196 | s12 | REF | 50% |
| 197 | s12 | REF | 35% |
| 198 | s12 | SNP | 35% |
| 199 | s12 | REF | 35% |
| 200 | s12 | REF | 50% |
| 201 | s12 | SNP | 50% |
| 202 | s12 | REF | 50% |
| 203 | s12 | REF | 40% |
| 204 | s12 | SNP | 50% |
| 205 | s12 | REF | 50% |
| 206 | s12 | SNP | 40% |
| 207 | s12 | REF | 35% |
| 208 | s12 | REF | 40% |
| 209 | s12 | REF | 35% |
| 210 | s12 | SNP | 35% |
| 211 | s12 | SNP | 35% |
| 212 | s13 | REF | 35% |
| 213 | s13 | SNP | 40% |
| 214 | s13 | SNP | 35% |
| 215 | s14 | REF | 55% |
| 216 | s14 | SNP | 60% |
| 217 | s14 | SNP | 55% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 218 | s14 | REF | 65% |
| 219 | s14 | SNP | 70% |
| 220 | s14 | SNP | 60% |
| 221 | s14 | REF | 55% |
| 222 | s14 | REF | 70% |
| 223 | s15 | REF | 55% |
| 224 | s15 | SNP | 60% |
| 225 | s15 | SNP | 35% |
| 226 | s15 | REF | 35% |
| 227 | s15 | SNP | 40% |
| 228 | s15 | SNP | 40% |
| 229 | s15 | REF | 55% |
| 230 | s15 | SNP | 60% |
| 231 | s16 | SNP | 70% |
| 232 | s16 | REF | 75% |
| 233 | s16 | SNP | 65% |
| 234 | s16 | REF | 70% |
| 235 | s16 | SNP | 60% |
| 236 | s16 | REF | 65% |
| 237 | s16 | SNP | 60% |
| 238 | s16 | REF | 65% |
| 239 | s16 | REF | 85% |
| 240 | s16 | SNP | 80% |
| 241 | s16 | SNP | 65% |
| 242 | s16 | REF | 70% |
| 243 | s16 | SNP | 70% |
| 244 | s16 | REF | 75% |
| 245 | s16 | REF | 70% |
| 246 | s16 | SNP | 65% |
| 247 | s16 | REF | 70% |
| 248 | s16 | SNP | 65% |
| 249 | s16 | SNP | 65% |
| 250 | s16 | REF | 70% |
| 251 | s16 | REF | 70% |
| 252 | s16 | SNP | 65% |
| 253 | s16 | REF | 65% |
| 254 | s16 | SNP | 60% |
| 255 | s16 | SNP | 70% |
| 256 | s16 | REF | 75% |
| 257 | s16 | REF | 70% |
| 258 | s16 | SNP | 65% |
| 259 | s16 | SNP | 65% |
| 260 | s16 | REF | 70% |
| 261 | s16 | REF | 65% |
| 262 | s16 | SNP | 60% |
| 263 | s16 | SNP | 65% |
| 264 | s16 | REF | 70% |
| 265 | s17 | REF | 65% |
| 266 | s17 | REF | 50% |
| 267 | s17 | SNP | 50% |
| 268 | s17 | SNP | 50% |
| 269 | s17 | SNP | 45% |
| 270 | s17 | SNP | 45% |
| 271 | s17 | REF | 50% |
| 272 | s17 | SNP | 55% |
| 273 | s17 | SNP | 45% |
| 274 | s18 | REF | 60% |
| 275 | s18 | SNP | 65% |
| 276 | s18 | REF | 60% |
| 277 | s18 | SNP | 65% |
| 278 | s18 | SNP | 65% |
| 279 | s18 | REF | 60% |
| 280 | s18 | REF | 60% |
| 281 | s18 | SNP | 65% |
| 282 | s18 | SNP | 65% |
| 283 | s18 | SNP | 65% |
| 284 | s18 | REF | 60% |
| 285 | s18 | REF | 60% |
| 286 | s18 | SNP | 65% |
| 287 | s18 | SNP | 70% |
| 288 | s18 | SNP | 60% |
| 289 | s18 | SNP | 60% |
| 290 | s18 | REF | 55% |
| 291 | s19 | SNP | 55% |
| 292 | s19 | REF | 55% |
| 293 | s19 | REF | 50% |
| 294 | s19 | SNP | 50% |
| 295 | s19 | REF | 50% |
| 296 | s19 | SNP | 55% |
| 297 | s19 | REF | 55% |
| 298 | s19 | REF | 60% |
| 299 | s19 | REF | 45% |
| 300 | s19 | SNP | 45% |
| 301 | s19 | REF | 55% |
| 302 | s19 | SNP | 60% |
| 303 | s19 | SNP | 55% |
| 304 | s19 | SNP | 50% |
| 305 | s19 | REF | 50% |
| 306 | s19 | SNP | 50% |
| 307 | s19 | REF | 55% |
| 308 | s19 | REF | 55% |
| 309 | s19 | REF | 45% |
| 310 | s19 | SNP | 45% |
| 311 | s19 | SNP | 50% |
| 312 | s19 | REF | 50% |
| 313 | s20 | REF | 60% |
| 314 | s20 | SNP | 65% |
| 315 | s20 | REF | 60% |
| 316 | s20 | SNP | 70% |
| 317 | s20 | REF | 65% |
| 318 | s20 | SNP | 70% |
| 319 | s20 | REF | 65% |
| 320 | s20 | REF | 60% |
| 321 | s20 | REF | 60% |
| 322 | s20 | SNP | 70% |
| 323 | s20 | SNP | 65% |
| 324 | s20 | REF | 65% |
| 325 | s20 | SNP | 70% |
| 326 | s20 | SNP | 70% |
| 327 | s20 | REF | 65% |
| 328 | s20 | REF | 65% |
| 329 | s20 | REF | 60% |
| 330 | s20 | SNP | 65% |
| 331 | s20 | REF | 65% |
| 332 | s20 | SNP | 70% |
| 333 | s21 | REF | 45% |
| 334 | s21 | SNP | 50% |
| 335 | s21 | REF | 45% |
| 336 | s21 | SNP | 50% |
| 337 | s21 | SNP | 50% |
| 338 | s21 | REF | 45% |
| 339 | s21 | REF | 45% |
| 340 | s21 | SNP | 50% |
| 341 | s21 | REF | 50% |
| 342 | s21 | SNP | 55% |
| 343 | s21 | SNP | 50% |
| 344 | s21 | REF | 45% |
| 345 | s21 | SNP | 45% |
| 346 | s21 | REF | 40% |
| 347 | s22 | REF | 45% |
| 348 | s22 | SNP | 40% |
| 349 | s22 | SNP | 45% |
| 350 | s22 | SNP | 45% |
| 351 | s22 | REF | 50% |
| 352 | s22 | REF | 50% |
| 353 | s22 | SNP | 45% |
| 354 | s22 | REF | 55% |
| 355 | s22 | REF | 50% |
| 356 | s22 | SNP | 45% |
| 357 | s22 | REF | 50% |
| 358 | s22 | REF | 50% |
| 359 | s22 | SNP | 50% |
| 360 | s22 | REF | 50% |
| 361 | s23 | SNP | 55% |
| 362 | s23 | SNP | 55% |
| 363 | s23 | REF | 60% |
| 364 | s23 | SNP | 60% |
| 365 | s23 | REF | 65% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 366 | s23 | SNP | 60% |
| 367 | s23 | SNP | 60% |
| 368 | s23 | SNP | 60% |
| 369 | s23 | REF | 65% |
| 370 | s23 | REF | 60% |
| 371 | s23 | SNP | 55% |
| 372 | s23 | REF | 60% |
| 373 | s23 | SNP | 55% |
| 374 | s23 | SNP | 60% |
| 375 | s23 | SNP | 55% |
| 376 | s23 | SNP | 55% |
| 377 | s23 | REF | 60% |
| 378 | s23 | REF | 60% |
| 379 | s23 | SNP | 55% |
| 380 | s39 | SNP | 65% |
| 381 | s39 | SNP | 70% |
| 382 | s39 | SNP | 70% |
| 383 | s39 | SNP | 70% |
| 384 | s39 | SNP | 75% |
| 385 | s39 | SNP | 70% |
| 386 | s39 | SNP | 65% |
| 387 | s24 | SNP | 70% |
| 388 | s24 | SNP | 60% |
| 389 | s24 | SNP | 65% |
| 390 | s24 | REF | 65% |
| 391 | s24 | SNP | 70% |
| 392 | s24 | SNP | 70% |
| 393 | s24 | SNP | 60% |
| 394 | s24 | SNP | 55% |
| 395 | s24 | SNP | 65% |
| 396 | s24 | SNP | 55% |
| 397 | s24 | SNP | 60% |
| 398 | s24 | SNP | 65% |
| 399 | s24 | SNP | 70% |
| 400 | s25 | SNP | 55% |
| 401 | s25 | REF | 60% |
| 402 | s25 | REF | 45% |
| 403 | s25 | SNP | 40% |
| 404 | s25 | REF | 65% |
| 405 | s25 | SNP | 60% |
| 406 | s25 | REF | 70% |
| 407 | s25 | SNP | 55% |
| 408 | s25 | REF | 60% |
| 409 | s25 | SNP | 65% |
| 410 | s25 | SNP | 65% |
| 411 | s25 | REF | 70% |
| 412 | s25 | REF | 75% |
| 413 | s25 | REF | 65% |
| 414 | s25 | SNP | 60% |
| 415 | s25 | REF | 50% |
| 416 | s25 | SNP | 45% |
| 417 | s25 | REF | 60% |
| 418 | s25 | SNP | 55% |
| 419 | s25 | REF | 60% |
| 420 | s25 | SNP | 55% |
| 421 | s25 | REF | 65% |
| 422 | s25 | SNP | 60% |
| 423 | s25 | SNP | 70% |
| 424 | s26 | SNP | 35% |
| 425 | s26 | REF | 35% |
| 426 | s26 | SNP | 35% |
| 427 | s26 | REF | 35% |
| 428 | s26 | SNP | 35% |
| 429 | s26 | SNP | 35% |
| 430 | s26 | REF | 35% |
| 431 | s26 | REF | 35% |
| 432 | s26 | SNP | 35% |
| 433 | s26 | REF | 40% |
| 434 | s26 | REF | 35% |
| 435 | s26 | REF | 35% |
| 436 | s73 | SNP | 50% |
| 437 | s27 | REF | 80% |
| 438 | s27 | REF | 80% |
| 439 | s27 | SNP | 85% |
| 440 | s27 | REF | 75% |
| 441 | s27 | SNP | 80% |
| 442 | s27 | REF | 80% |
| 443 | s27 | REF | 75% |
| 444 | s27 | SNP | 80% |
| 445 | s27 | REF | 80% |
| 446 | s27 | SNP | 85% |
| 447 | s27 | SNP | 85% |
| 448 | s27 | SNP | 80% |
| 449 | s27 | SNP | 85% |
| 450 | s27 | REF | 80% |
| 451 | s27 | REF | 75% |
| 452 | s27 | SNP | 85% |
| 453 | s27 | REF | 80% |
| 454 | s27 | REF | 80% |
| 455 | s27 | SNP | 85% |
| 456 | s27 | SNP | 85% |
| 457 | s27 | SNP | 80% |
| 458 | s27 | REF | 75% |
| 459 | s27 | REF | 80% |
| 460 | s27 | SNP | 85% |
| 461 | s27 | REF | 75% |
| 462 | s27 | SNP | 85% |
| 463 | s27 | REF | 80% |
| 464 | s27 | REF | 80% |
| 465 | s27 | SNP | 85% |
| 466 | s4 | SNP | 45% |
| 467 | s4 | SNP | 45% |
| 468 | s4 | SNP | 40% |
| 469 | s28 | REF | 70% |
| 470 | s28 | SNP | 65% |
| 471 | s28 | SNP | 65% |
| 472 | s28 | REF | 70% |
| 473 | s28 | SNP | 65% |
| 474 | s28 | REF | 70% |
| 475 | s28 | SNP | 65% |
| 476 | s28 | SNP | 65% |
| 477 | s28 | REF | 70% |
| 478 | s28 | SNP | 65% |
| 479 | s28 | SNP | 65% |
| 480 | s28 | SNP | 65% |
| 481 | s28 | SNP | 65% |
| 482 | s28 | SNP | 65% |
| 483 | s28 | REF | 70% |
| 484 | s3 | SNP | 45% |
| 485 | s3 | SNP | 45% |
| 486 | s3 | SNP | 40% |
| 487 | s30 | REF | 45% |
| 488 | s30 | SNP | 50% |
| 489 | s30 | REF | 35% |
| 490 | s30 | SNP | 40% |
| 491 | s30 | REF | 50% |
| 492 | s30 | SNP | 55% |
| 493 | s30 | REF | 40% |
| 494 | s30 | SNP | 45% |
| 495 | s30 | SNP | 40% |
| 496 | s30 | REF | 35% |
| 497 | s30 | SNP | 45% |
| 498 | s30 | REF | 40% |
| 499 | s31 | REF | 70% |
| 500 | s31 | REF | 50% |
| 501 | s31 | SNP | 55% |
| 502 | s31 | REF | 65% |
| 503 | s31 | SNP | 70% |
| 504 | s31 | SNP | 75% |
| 505 | s31 | REF | 50% |
| 506 | s31 | SNP | 55% |
| 507 | s31 | REF | 75% |
| 508 | s31 | SNP | 55% |
| 509 | s31 | SNP | 50% |
| 510 | s31 | SNP | 55% |
| 511 | s31 | REF | 50% |
| 512 | s31 | REF | 70% |
| 513 | s31 | REF | 65% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 514 | s31 | SNP | 70% |
| 515 | s31 | REF | 55% |
| 516 | s31 | SNP | 60% |
| 517 | s31 | REF | 65% |
| 518 | s31 | SNP | 70% |
| 519 | s31 | SNP | 70% |
| 520 | s31 | SNP | 70% |
| 521 | s31 | REF | 65% |
| 522 | s31 | SNP | 75% |
| 523 | s31 | REF | 70% |
| 524 | s31 | REF | 60% |
| 525 | s31 | SNP | 65% |
| 526 | s31 | REF | 65% |
| 527 | s31 | REF | 50% |
| 528 | s31 | REF | 55% |
| 529 | s31 | SNP | 60% |
| 530 | s32 | SNP | 60% |
| 531 | s32 | SNP | 65% |
| 532 | s32 | SNP | 70% |
| 533 | s32 | REF | 75% |
| 534 | s32 | SNP | 65% |
| 535 | s32 | REF | 75% |
| 536 | s32 | SNP | 65% |
| 537 | s32 | REF | 70% |
| 538 | s32 | REF | 70% |
| 539 | s32 | SNP | 65% |
| 540 | s32 | SNP | 65% |
| 541 | s32 | REF | 70% |
| 542 | s32 | SNP | 65% |
| 543 | s32 | REF | 70% |
| 544 | s32 | REF | 75% |
| 545 | s74 | SNP | 65% |
| 546 | s74 | SNP | 65% |
| 547 | s74 | SNP | 65% |
| 548 | s33 | REF | 50% |
| 549 | s33 | SNP | 55% |
| 550 | s33 | REF | 40% |
| 551 | s33 | SNP | 45% |
| 552 | s33 | REF | 55% |
| 553 | s33 | SNP | 60% |
| 554 | s33 | REF | 40% |
| 555 | s33 | REF | 45% |
| 556 | s33 | REF | 60% |
| 557 | s33 | SNP | 65% |
| 558 | s33 | SNP | 65% |
| 559 | s33 | REF | 60% |
| 560 | s33 | SNP | 50% |
| 561 | s33 | SNP | 60% |
| 562 | s33 | REF | 55% |
| 563 | s33 | REF | 40% |
| 564 | s33 | SNP | 45% |
| 565 | s33 | SNP | 60% |
| 566 | s33 | REF | 55% |
| 567 | s33 | REF | 35% |
| 568 | s33 | SNP | 40% |
| 569 | s33 | SNP | 55% |
| 570 | s33 | REF | 50% |
| 571 | s33 | SNP | 60% |
| 572 | s33 | REF | 55% |
| 573 | s34 | SNP | 35% |
| 574 | s34 | REF | 50% |
| 575 | s34 | SNP | 45% |
| 576 | s34 | SNP | 50% |
| 577 | s34 | REF | 55% |
| 578 | s34 | SNP | 50% |
| 579 | s34 | REF | 55% |
| 580 | s34 | REF | 50% |
| 581 | s34 | SNP | 45% |
| 582 | s34 | REF | 50% |
| 583 | s34 | SNP | 45% |
| 584 | s35 | SNP | 70% |
| 585 | s35 | REF | 75% |
| 586 | s35 | REF | 75% |
| 587 | s35 | SNP | 70% |
| 588 | s35 | SNP | 70% |
| 589 | s35 | REF | 75% |
| 590 | s35 | REF | 85% |
| 591 | s35 | SNP | 80% |
| 592 | s35 | SNP | 75% |
| 593 | s35 | REF | 80% |
| 594 | s35 | REF | 75% |
| 595 | s35 | SNP | 70% |
| 596 | s35 | SNP | 85% |
| 597 | s35 | REF | 90% |
| 598 | s35 | REF | 85% |
| 599 | s35 | SNP | 80% |
| 600 | s35 | REF | 80% |
| 601 | s35 | SNP | 75% |
| 602 | s35 | SNP | 80% |
| 603 | s35 | REF | 85% |
| 604 | s35 | SNP | 70% |
| 605 | s35 | REF | 75% |
| 606 | s35 | REF | 75% |
| 607 | s35 | SNP | 70% |
| 608 | s35 | SNP | 80% |
| 609 | s35 | REF | 85% |
| 610 | s35 | SNP | 75% |
| 611 | s35 | REF | 80% |
| 612 | s35 | REF | 75% |
| 613 | s35 | SNP | 70% |
| 614 | s35 | SNP | 80% |
| 615 | s35 | REF | 85% |
| 616 | s35 | REF | 80% |
| 617 | s35 | SNP | 75% |
| 618 | s35 | REF | 80% |
| 619 | s35 | SNP | 75% |
| 620 | s35 | REF | 75% |
| 621 | s35 | SNP | 70% |
| 622 | s36 | SNP | 60% |
| 623 | s36 | REF | 65% |
| 624 | s36 | SNP | 70% |
| 625 | s36 | SNP | 65% |
| 626 | s36 | REF | 70% |
| 627 | s36 | SNP | 65% |
| 628 | s36 | SNP | 70% |
| 629 | s36 | SNP | 70% |
| 630 | s36 | SNP | 70% |
| 631 | s36 | SNP | 65% |
| 632 | s36 | SNP | 60% |
| 633 | s36 | REF | 65% |
| 634 | s36 | SNP | 65% |
| 635 | s36 | SNP | 65% |
| 636 | s36 | SNP | 65% |
| 637 | s36 | SNP | 65% |
| 638 | s36 | SNP | 65% |
| 639 | s36 | SNP | 70% |
| 640 | s29 | SNP | 70% |
| 641 | s29 | SNP | 70% |
| 642 | s29 | SNP | 75% |
| 643 | s29 | SNP | 75% |
| 644 | s29 | SNP | 65% |
| 645 | s29 | REF | 65% |
| 646 | s40 | SNP | 40% |
| 647 | s41 | SNP | 55% |
| 648 | s41 | REF | 60% |
| 649 | s41 | SNP | 65% |
| 650 | s41 | REF | 70% |
| 651 | s41 | REF | 75% |
| 652 | s41 | SNP | 70% |
| 653 | s41 | SNP | 60% |
| 654 | s41 | REF | 65% |
| 655 | s41 | REF | 60% |
| 656 | s41 | SNP | 65% |
| 657 | s41 | REF | 70% |
| 658 | s41 | SNP | 75% |
| 659 | s41 | REF | 80% |
| 660 | s41 | SNP | 55% |
| 661 | s41 | REF | 65% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 662 | s41 | SNP | 60% |
| 663 | s41 | SNP | 60% |
| 664 | s41 | REF | 65% |
| 665 | s41 | SNP | 55% |
| 666 | s41 | REF | 60% |
| 667 | s41 | SNP | 75% |
| 668 | s41 | REF | 80% |
| 669 | s42 | SNP | 65% |
| 670 | s42 | REF | 80% |
| 671 | s42 | SNP | 65% |
| 672 | s42 | SNP | 65% |
| 673 | s42 | REF | 70% |
| 674 | s42 | REF | 65% |
| 675 | s42 | SNP | 60% |
| 676 | s2 | SNP | 60% |
| 677 | s45 | SNP | 40% |
| 678 | s45 | REF | 45% |
| 679 | s45 | SNP | 40% |
| 680 | s45 | REF | 45% |
| 681 | s45 | SNP | 50% |
| 682 | s45 | REF | 55% |
| 683 | s45 | REF | 45% |
| 684 | s45 | SNP | 40% |
| 685 | s45 | REF | 45% |
| 686 | s76 | SNP | 50% |
| 687 | s76 | SNP | 50% |
| 688 | s46 | REF | 65% |
| 689 | s46 | SNP | 60% |
| 690 | s46 | REF | 65% |
| 691 | s46 | REF | 70% |
| 692 | s46 | SNP | 65% |
| 693 | s46 | SNP | 70% |
| 694 | s46 | REF | 75% |
| 695 | s46 | SNP | 65% |
| 696 | s46 | REF | 70% |
| 697 | s46 | SNP | 65% |
| 698 | s46 | REF | 70% |
| 699 | s46 | REF | 65% |
| 700 | s46 | SNP | 60% |
| 701 | s47 | SNP | 50% |
| 702 | s47 | SNP | 55% |
| 703 | s47 | REF | 80% |
| 704 | s47 | REF | 60% |
| 705 | s47 | SNP | 70% |
| 706 | s47 | REF | 75% |
| 707 | s47 | SNP | 65% |
| 708 | s47 | REF | 70% |
| 709 | s47 | REF | 65% |
| 710 | s47 | SNP | 60% |
| 711 | s47 | SNP | 75% |
| 712 | s47 | REF | 55% |
| 713 | s47 | REF | 60% |
| 714 | s47 | SNP | 55% |
| 715 | s48 | SNP | 55% |
| 716 | s48 | SNP | 65% |
| 717 | s48 | SNP | 65% |
| 718 | s48 | SNP | 65% |
| 719 | s48 | REF | 70% |
| 720 | s48 | REF | 70% |
| 721 | s48 | SNP | 65% |
| 722 | s48 | REF | 70% |
| 723 | s48 | SNP | 60% |
| 724 | s48 | REF | 70% |
| 725 | s48 | SNP | 55% |
| 726 | s48 | SNP | 60% |
| 727 | s48 | REF | 70% |
| 728 | s48 | REF | 70% |
| 729 | s48 | SNP | 65% |
| 730 | s48 | SNP | 50% |
| 731 | s48 | SNP | 50% |
| 732 | s48 | SNP | 60% |
| 733 | s48 | SNP | 65% |
| 734 | s49 | SNP | 55% |
| 735 | s49 | REF | 50% |
| 736 | s49 | SNP | 55% |
| 737 | s49 | REF | 50% |
| 738 | s49 | REF | 50% |
| 739 | s49 | SNP | 55% |
| 740 | s49 | REF | 50% |
| 741 | s49 | REF | 55% |
| 742 | s49 | SNP | 60% |
| 743 | s1, s2, s3, s4 | BOTH, REF, REF, BOTH | 60% |
| 744 | s1, s2, s3, s4 | BOTH, REF, BOTH, BOTH | 60% |
| 745 | s1, s2, s3, s4 | BOTH, REF, REF, REF | 55% |
| 746 | s1, s2, s3, s4 | BOTH, REF, REF, REF | 60% |
| 747 | s1, s2, s3, s4 | REF, REF, REF, REF | 45% |
| 748 | s1, s2, s3, s4 | REF, REF, REF, REF | 50% |
| 749 | s1, s2, s3, s4 | REF, REF, REF, REF | 55% |
| 750 | s1, s2, s3, s4 | REF, REF, REF, REF | 45% |
| 751 | s1, s2, s3, s4 | REF, REF, REF, REF | 55% |
| 752 | s5, s6 | REF, BOTH | 40% |
| 753 | s5, s6 | REF, BOTH | 40% |
| 754 | s5, s6 | REF, BOTH | 35% |
| 755 | s5, s6 | REF, BOTH | 35% |
| 756 | s5, s6 | REF, BOTH | 35% |
| 757 | s5, s6 | REF, BOTH | 35% |
| 758 | s5, s6 | REF, BOTH | 35% |
| 759 | s5, s6, s7 | REF, BOTH, BOTH | 35% |
| 760 | s5, s6, s7 | REF, BOTH, BOTH | 40% |
| 761 | s8 | BOTH | 40% |
| 762 | s8 | BOTH | 50% |
| 763 | s8 | BOTH | 40% |
| 764 | s9 | BOTH | 60% |
| 765 | s9 | BOTH | 50% |
| 766 | s9 | BOTH | 55% |
| 767 | s9 | BOTH | 50% |
| 768 | s10 | BOTH | 70% |
| 769 | s10 | BOTH | 65% |
| 770 | s10 | BOTH | 65% |
| 771 | s10 | BOTH | 65% |
| 772 | s11 | BOTH | 50% |
| 773 | s11 | BOTH | 45% |
| 774 | s12 | BOTH | 55% |
| 775 | s12 | BOTH | 45% |
| 776 | s12 | BOTH | 45% |
| 777 | s12 | BOTH | 40% |
| 778 | s12 | BOTH | 60% |
| 779 | s12 | BOTH | 60% |
| 780 | s13 | BOTH | 45% |
| 781 | s13 | BOTH | 50% |
| 782 | s13 | BOTH | 50% |
| 783 | s13 | BOTH | 35% |
| 784 | s14 | BOTH | 65% |
| 785 | s14 | BOTH | 60% |
| 786 | s14 | BOTH | 50% |
| 787 | s15 | BOTH | 35% |
| 788 | s15 | BOTH | 40% |
| 789 | s16 | BOTH | 65% |
| 790 | s16 | BOTH | 70% |
| 791 | s16 | BOTH | 80% |
| 792 | s18 | BOTH | 55% |
| 793 | s18 | BOTH | 55% |
| 794 | s18 | BOTH | 60% |
| 795 | s19 | BOTH | 55% |
| 796 | s19 | BOTH | 55% |
| 797 | s19 | BOTH | 60% |
| 798 | s19 | BOTH | 60% |
| 799 | s20 | BOTH | 70% |
| 800 | s20 | BOTH | 65% |
| 801 | s21 | BOTH | 55% |
| 802 | s21 | BOTH | 60% |
| 803 | s21 | BOTH | 50% |
| 804 | s21 | BOTH | 45% |
| 805 | s22 | BOTH | 50% |
| 806 | s22 | BOTH | 55% |
| 807 | s22 | BOTH | 50% |
| 808 | s22 | BOTH | 50% |
| 809 | s22 | BOTH | 50% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 810 | s22 | BOTH | 50% |
| 811 | s23 | BOTH | 60% |
| 812 | s23 | BOTH | 60% |
| 813 | s23 | BOTH | 70% |
| 814 | s23 | BOTH | 65% |
| 815 | s24 | BOTH | 60% |
| 816 | s24 | BOTH | 60% |
| 817 | s24 | BOTH | 60% |
| 818 | s24 | BOTH | 60% |
| 819 | s25 | BOTH | 50% |
| 820 | s25 | BOTH | 50% |
| 821 | s25 | BOTH | 75% |
| 822 | s25 | BOTH | 50% |
| 823 | s25 | BOTH | 50% |
| 824 | s26 | BOTH | 40% |
| 825 | s26 | BOTH | 40% |
| 826 | s26 | BOTH | 40% |
| 827 | s26 | BOTH | 45% |
| 828 | s27 | BOTH | 80% |
| 829 | s27 | BOTH | 85% |
| 830 | s27 | BOTH | 80% |
| 831 | s27 | BOTH | 85% |
| 832 | s27 | BOTH | 80% |
| 833 | s28 | BOTH | 65% |
| 834 | s28 | BOTH | 70% |
| 835 | s28, s29 | BOTH, REF | 65% |
| 836 | s28, s29 | REF, BOTH | 70% |
| 837 | s30 | BOTH | 60% |
| 838 | s30 | BOTH | 60% |
| 839 | s30 | BOTH | 65% |
| 840 | s30 | BOTH | 35% |
| 841 | s30 | BOTH | 60% |
| 842 | s31 | BOTH | 50% |
| 843 | s31 | BOTH | 75% |
| 844 | s31 | BOTH | 50% |
| 845 | s32 | BOTH | 70% |
| 846 | s32 | BOTH | 70% |
| 847 | s32 | BOTH | 70% |
| 848 | s32 | BOTH | 60% |
| 849 | s33 | BOTH | 35% |
| 850 | s33 | BOTH | 35% |
| 851 | s34 | BOTH | 45% |
| 852 | s34 | BOTH | 45% |
| 853 | s34 | BOTH | 45% |
| 854 | s35 | BOTH | 90% |
| 855 | s35 | BOTH | 75% |
| 856 | s35 | BOTH | 80% |
| 857 | s35 | BOTH | 80% |
| 858 | s35 | BOTH | 85% |
| 859 | s36, s24 | REF, BOTH | 65% |
| 860 | s36, s24 | REF, REF | 70% |
| 861 | s36, s24 | REF, REF | 65% |
| 862 | s36, s24 | REF, REF | 75% |
| 863 | s36, s24 | REF, REF | 65% |
| 864 | s36, s24 | REF, REF | 70% |
| 865 | s36, s24 | REF, REF | 75% |
| 866 | s36, s24 | REF, REF | 65% |
| 867 | s36, s24 | REF, REF | 75% |
| 868 | s36, s24 | REF, REF | 65% |
| 869 | s36, s24 | REF, REF | 75% |
| 870 | s36, s24 | REF, REF | 75% |
| 871 | s36, s24 | REF, REF | 60% |
| 872 | s36, s24 | REF, REF | 60% |
| 873 | s36, s24 | REF, REF | 65% |
| 874 | s36, s24 | BOTH, REF | 60% |
| 875 | s36 | BOTH | 60% |
| 876 | s36 | BOTH | 60% |
| 877 | s36 | BOTH | 60% |
| 878 | s36 | BOTH | 65% |
| 879 | s7, s37 | SNP, SNP | 50% |
| 880 | s7, s38 | SNP, SNP | 50% |
| 881 | s29, s39 | REF, BOTH | 65% |
| 882 | s29, s39 | REF, BOTH | 65% |
| 883 | s29, s39 | REF, REF | 65% |
| 884 | s29, s39 | REF, REF | 75% |
| 885 | s29, s39 | REF, REF | 75% |
| 886 | s29, s39 | REF, REF | 75% |
| 887 | s29, s39 | REF, REF | 75% |
| 888 | s29 | BOTH | 70% |
| 889 | s29 | BOTH | 70% |
| 890 | s40 | BOTH | 40% |
| 891 | s40 | BOTH | 45% |
| 892 | s40 | BOTH | 45% |
| 893 | s40 | BOTH | 40% |
| 894 | s41 | BOTH | 75% |
| 895 | s41 | BOTH | 60% |
| 896 | s41 | BOTH | 80% |
| 897 | s41 | BOTH | 75% |
| 898 | s41 | BOTH | 60% |
| 899 | s42 | BOTH | 55% |
| 900 | s42 | BOTH | 80% |
| 901 | s43 | BOTH | 50% |
| 902 | s43 | BOTH | 55% |
| 903 | s43 | BOTH | 55% |
| 904 | s43 | BOTH | 60% |
| 905 | s43 | BOTH | 55% |
| 906 | s43 | BOTH | 60% |
| 907 | s44 | BOTH | 50% |
| 908 | s44 | BOTH | 55% |
| 909 | s44 | BOTH | 50% |
| 910 | s44 | BOTH | 55% |
| 911 | s2, s3, s4 | REF, REF, REF | 40% |
| 912 | s2, s3, s4 | REF, REF, REF | 35% |
| 913 | s2, s3, s4 | REF, REF, REF | 50% |
| 914 | s2, s3, s4 | REF, REF, REF | 60% |
| 915 | s2, s3, s4 | REF, REF, REF | 55% |
| 916 | s2, s3 | BOTH, BOTH | 65% |
| 917 | s2, s3 | REF, REF | 60% |
| 918 | s2 | BOTH | 65% |
| 919 | s45 | BOTH | 50% |
| 920 | s45 | BOTH | 50% |
| 921 | s45 | BOTH | 45% |
| 922 | s45 | BOTH | 45% |
| 923 | s45 | BOTH | 40% |
| 924 | s45 | BOTH | 45% |
| 925 | s46 | BOTH | 65% |
| 926 | s46 | BOTH | 55% |
| 927 | s46 | BOTH | 65% |
| 928 | s46 | BOTH | 65% |
| 929 | s46 | BOTH | 55% |
| 930 | s47 | BOTH | 50% |
| 931 | s47 | BOTH | 70% |
| 932 | s47 | BOTH | 45% |
| 933 | s48 | BOTH | 70% |
| 934 | s49 | BOTH | 60% |
| 935 | s49 | BOTH | 60% |
| 936 | s49 | BOTH | 60% |
| 937 | s49 | BOTH | 60% |
| 938 | s50 | BOTH | 75% |
| 939 | s50 | BOTH | 70% |
| 940 | s50 | BOTH | 70% |
| 941 | s50 | BOTH | 80% |
| 942 | s50 | BOTH | 70% |
| 943 | s51 | BOTH | 60% |
| 944 | s51 | BOTH | 75% |
| 945 | s51 | BOTH | 75% |
| 946 | s52 | BOTH | 80% |
| 947 | s52 | BOTH | 70% |
| 948 | s52 | BOTH | 80% |
| 949 | s52 | BOTH | 65% |
| 950 | s52 | BOTH | 75% |
| 951 | s53 | BOTH | 80% |
| 952 | s53 | BOTH | 50% |
| 953 | s53 | BOTH | 80% |
| 954 | s54 | BOTH | 75% |
| 955 | s54 | BOTH | 60% |
| 956 | s54 | BOTH | 70% |
| 957 | s54 | BOTH | 75% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 958 | s54 | BOTH | 70% |
| 959 | s55 | BOTH | 45% |
| 960 | s55 | BOTH | 55% |
| 961 | s55 | BOTH | 55% |
| 962 | s55 | BOTH | 55% |
| 963 | s55 | BOTH | 55% |
| 964 | s55 | BOTH | 50% |
| 965 | s56 | BOTH | 60% |
| 966 | s56 | BOTH | 60% |
| 967 | s56 | BOTH | 70% |
| 968 | s56 | BOTH | 50% |
| 969 | s57 | BOTH | 40% |
| 970 | s57 | BOTH | 45% |
| 971 | s57 | BOTH | 60% |
| 972 | s57 | BOTH | 60% |
| 973 | s57 | BOTH | 45% |
| 974 | s58 | BOTH | 45% |
| 975 | s58 | BOTH | 50% |
| 976 | s58 | BOTH | 50% |
| 977 | s58 | BOTH | 50% |
| 978 | s58 | BOTH | 40% |
| 979 | s58 | BOTH | 40% |
| 980 | s59 | BOTH | 50% |
| 981 | s59 | BOTH | 45% |
| 982 | s59 | BOTH | 40% |
| 983 | s60 | BOTH | 45% |
| 984 | s60 | BOTH | 45% |
| 985 | s60 | BOTH | 55% |
| 986 | s60 | BOTH | 60% |
| 987 | s60 | BOTH | 50% |
| 988 | s60 | BOTH | 50% |
| 989 | s61 | BOTH | 45% |
| 990 | s61 | BOTH | 50% |
| 991 | s61 | BOTH | 45% |
| 992 | s61 | BOTH | 55% |
| 993 | s61 | BOTH | 50% |
| 994 | s62 | BOTH | 50% |
| 995 | s62 | BOTH | 60% |
| 996 | s62 | BOTH | 50% |
| 997 | s62 | BOTH | 55% |
| 998 | s62 | BOTH | 55% |
| 999 | s63, s48 | REF, BOTH | 70% |
| 1000 | s63, s48 | REF, BOTH | 70% |
| 1001 | s63, s48 | REF, BOTH | 65% |
| 1002 | s63, s48 | BOTH, REF | 60% |
| 1003 | s63, s48 | BOTH, REF | 65% |
| 1004 | s63, s48 | BOTH, REF | 65% |
| 1005 | s63, s48 | REF, REF | 70% |
| 1006 | s63, s48 | REF, REF | 70% |
| 1007 | s63, s48 | REF, REF | 65% |
| 1008 | s63, s48 | REF, REF | 70% |
| 1009 | s63, s48 | REF, REF | 60% |
| 1010 | s63, s48 | REF, REF | 70% |
| 1011 | s63, s48 | REF, REF | 60% |
| 1012 | s63, s48 | REF, REF | 70% |
| 1013 | s63, s48 | REF, REF | 60% |
| 1014 | s63, s48 | REF, REF | 60% |
| 1015 | s63, s48 | REF, REF | 65% |
| 1016 | s63, s48 | REF, REF | 65% |
| 1017 | s63 | BOTH | 75% |
| 1018 | s64, s17 | REF, BOTH | 45% |
| 1019 | s64, s17 | REF, BOTH | 50% |
| 1020 | s64, s17 | REF, BOTH | 50% |
| 1021 | s64, s17 | REF, BOTH | 45% |
| 1022 | s64, s17 | BOTH, REF | 45% |
| 1023 | s64, s17 | BOTH, REF | 40% |
| 1024 | s64, s17 | REF, REF | 40% |
| 1025 | s64, s17 | REF, REF | 35% |
| 1026 | s64, s17 | REF, REF | 40% |
| 1027 | s64, s17 | REF, REF | 40% |
| 1028 | s64, s17 | REF, REF | 40% |
| 1029 | s64, s17 | REF, REF | 40% |
| 1030 | s64, s17 | REF, REF | 40% |
| 1031 | s64, s17 | REF, REF | 40% |
| 1032 | s64, s17 | REF, REF | 40% |
| 1033 | s64, s17 | REF, REF | 40% |
| 1034 | s64, s17 | REF, REF | 40% |
| 1035 | s64, s17 | REF, REF | 35% |
| 1036 | s64, s17 | REF, REF | 40% |
| 1037 | s64 | BOTH | 70% |
| 1038 | s65 | BOTH | 65% |
| 1039 | s65 | BOTH | 65% |
| 1040 | s66 | BOTH | 65% |
| 1041 | s66 | BOTH | 65% |
| 1042 | s66 | BOTH | 45% |
| 1043 | s66 | BOTH | 50% |
| 1044 | s66 | BOTH | 65% |
| 1045 | s66 | BOTH | 55% |
| 1046 | s67 | BOTH | 35% |
| 1047 | s67 | BOTH | 40% |
| 1048 | s67 | BOTH | 50% |
| 1049 | s67 | BOTH | 60% |
| 1050 | s67 | BOTH | 55% |
| 1051 | s68 | BOTH | 50% |
| 1052 | s68 | BOTH | 40% |
| 1053 | s68 | BOTH | 50% |
| 1054 | s1 | SNP | 45% |
| 1055 | s1 | SNP | 50% |
| 1056 | s1 | SNP | 45% |
| 1057 | s1 | SNP | 50% |
| 1058 | s5 | SNP | 40% |
| 1059 | s5 | SNP | 40% |
| 1060 | s5 | SNP | 35% |
| 1061 | s69 | SNP | 40% |
| 1062 | s8 | REF | 60% |
| 1063 | s8 | SNP | 65% |
| 1064 | s8 | REF | 40% |
| 1065 | s8 | SNP | 45% |
| 1066 | s8 | SNP | 45% |
| 1067 | s8 | SNP | 45% |
| 1068 | s8 | REF | 40% |
| 1069 | s8 | SNP | 50% |
| 1070 | s8 | REF | 45% |
| 1071 | s8 | REF | 50% |
| 1072 | s8 | REF | 40% |
| 1073 | s8 | SNP | 45% |
| 1074 | s8 | REF | 55% |
| 1075 | s8 | SNP | 60% |
| 1076 | s8 | SNP | 55% |
| 1077 | s8 | REF | 50% |
| 1078 | s8 | SNP | 60% |
| 1079 | s8 | REF | 55% |
| 1080 | s8 | SNP | 65% |
| 1081 | s8 | REF | 60% |
| 1082 | s8 | SNP | 45% |
| 1083 | s8 | SNP | 45% |
| 1084 | s8 | SNP | 45% |
| 1085 | s8 | REF | 40% |
| 1086 | s8 | REF | 40% |
| 1087 | s8 | SNP | 45% |
| 1088 | s8 | REF | 40% |
| 1089 | s8 | REF | 40% |
| 1090 | s8 | SNP | 60% |
| 1091 | s8 | SNP | 65% |
| 1092 | s8 | REF | 40% |
| 1093 | s8 | SNP | 45% |
| 1094 | s8 | SNP | 50% |
| 1095 | s8 | REF | 45% |
| 1096 | s8 | REF | 40% |
| 1097 | s8 | SNP | 45% |
| 1098 | s8 | REF | 40% |
| 1099 | s8 | SNP | 45% |
| 1100 | s8 | SNP | 65% |
| 1101 | s8 | SNP | 65% |
| 1102 | s8 | SNP | 55% |
| 1103 | s8 | SNP | 65% |
| 1104 | s8 | SNP | 65% |
| 1105 | s8 | REF | 60% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 1106 | s8 | SNP | 55% |
| 1107 | s8 | SNP | 60% |
| 1108 | s8 | REF | 55% |
| 1109 | s8 | REF | 40% |
| 1110 | s8 | SNP | 65% |
| 1111 | s8 | REF | 60% |
| 1112 | s8 | SNP | 55% |
| 1113 | s8 | SNP | 65% |
| 1114 | s8 | REF | 60% |
| 1115 | s9 | REF | 60% |
| 1116 | s9 | SNP | 55% |
| 1117 | s9 | REF | 60% |
| 1118 | s9 | SNP | 55% |
| 1119 | s9 | SNP | 60% |
| 1120 | s9 | SNP | 60% |
| 1121 | s9 | REF | 65% |
| 1122 | s9 | REF | 60% |
| 1123 | s9 | SNP | 55% |
| 1124 | s9 | REF | 55% |
| 1125 | s9 | REF | 65% |
| 1126 | s9 | SNP | 60% |
| 1127 | s9 | REF | 65% |
| 1128 | s9 | SNP | 60% |
| 1129 | s9 | REF | 65% |
| 1130 | s9 | SNP | 60% |
| 1131 | s9 | REF | 65% |
| 1132 | s9 | REF | 65% |
| 1133 | s9 | SNP | 60% |
| 1134 | s9 | SNP | 60% |
| 1135 | s9 | REF | 70% |
| 1136 | s9 | SNP | 65% |
| 1137 | s9 | SNP | 65% |
| 1138 | s9 | REF | 70% |
| 1139 | s9 | REF | 65% |
| 1140 | s9 | SNP | 60% |
| 1141 | s9 | SNP | 60% |
| 1142 | s9 | REF | 65% |
| 1143 | s9 | SNP | 60% |
| 1144 | s9 | REF | 65% |
| 1145 | s9 | REF | 65% |
| 1146 | s9 | SNP | 60% |
| 1147 | s9 | SNP | 65% |
| 1148 | s9 | REF | 70% |
| 1149 | s9 | REF | 65% |
| 1150 | s9 | SNP | 60% |
| 1151 | s9 | REF | 65% |
| 1152 | s9 | SNP | 60% |
| 1153 | s9 | REF | 65% |
| 1154 | s9 | SNP | 60% |
| 1155 | s9 | SNP | 60% |
| 1156 | s9 | REF | 65% |
| 1157 | s9 | REF | 65% |
| 1158 | s9 | SNP | 50% |
| 1159 | s9 | SNP | 60% |
| 1160 | s9 | REF | 65% |
| 1161 | s9 | SNP | 60% |
| 1162 | s9 | SNP | 60% |
| 1163 | s9 | REF | 65% |
| 1164 | s9 | SNP | 60% |
| 1165 | s9 | SNP | 55% |
| 1166 | s9 | REF | 60% |
| 1167 | s70 | SNP | 65% |
| 1168 | s70 | SNP | 75% |
| 1169 | s70 | SNP | 80% |
| 1170 | s70 | SNP | 55% |
| 1171 | s70 | REF | 60% |
| 1172 | s70 | REF | 75% |
| 1173 | s70 | SNP | 70% |
| 1174 | s70 | REF | 75% |
| 1175 | s70 | REF | 70% |
| 1176 | s70 | SNP | 70% |
| 1177 | s70 | SNP | 75% |
| 1178 | s70 | REF | 65% |
| 1179 | s71 | SNP | 45% |
| 1180 | s71 | SNP | 65% |
| 1181 | s71 | SNP | 65% |
| 1182 | s71 | SNP | 55% |
| 1183 | s71 | SNP | 65% |
| 1184 | s71 | SNP | 45% |
| 1185 | s71 | SNP | 45% |
| 1186 | s71 | SNP | 50% |
| 1187 | s10 | REF | 65% |
| 1188 | s10 | SNP | 70% |
| 1189 | s10 | SNP | 75% |
| 1190 | s10 | REF | 70% |
| 1191 | s10 | SNP | 70% |
| 1192 | s10 | REF | 65% |
| 1193 | s10 | REF | 55% |
| 1194 | s10 | REF | 65% |
| 1195 | s10 | SNP | 70% |
| 1196 | s10 | SNP | 75% |
| 1197 | s10 | REF | 70% |
| 1198 | s10 | SNP | 75% |
| 1199 | s10 | REF | 70% |
| 1200 | s10 | REF | 55% |
| 1201 | s10 | SNP | 80% |
| 1202 | s10 | REF | 75% |
| 1203 | s10 | SNP | 70% |
| 1204 | s10 | SNP | 70% |
| 1205 | s10 | REF | 55% |
| 1206 | s10 | SNP | 60% |
| 1207 | s10 | REF | 65% |
| 1208 | s10 | SNP | 70% |
| 1209 | s10 | SNP | 80% |
| 1210 | s10 | SNP | 60% |
| 1211 | s10 | REF | 55% |
| 1212 | s10 | REF | 70% |
| 1213 | s10 | SNP | 75% |
| 1214 | s10 | SNP | 60% |
| 1215 | s10 | REF | 55% |
| 1216 | s10 | SNP | 60% |
| 1217 | s10 | REF | 65% |
| 1218 | s10 | REF | 65% |
| 1219 | s10 | SNP | 70% |
| 1220 | s10 | SNP | 75% |
| 1221 | s10 | REF | 70% |
| 1222 | s10 | SNP | 70% |
| 1223 | s10 | REF | 60% |
| 1224 | s10 | SNP | 65% |
| 1225 | s10 | REF | 65% |
| 1226 | s10 | REF | 65% |
| 1227 | s10 | SNP | 70% |
| 1228 | s10 | REF | 65% |
| 1229 | s10 | SNP | 70% |
| 1230 | s10 | REF | 65% |
| 1231 | s10 | SNP | 70% |
| 1232 | s10 | SNP | 75% |
| 1233 | s10 | SNP | 60% |
| 1234 | s10 | REF | 70% |
| 1235 | s10 | SNP | 75% |
| 1236 | s10 | REF | 55% |
| 1237 | s10 | SNP | 75% |
| 1238 | s10 | REF | 70% |
| 1239 | s10 | REF | 70% |
| 1240 | s10 | SNP | 75% |
| 1241 | s10 | SNP | 60% |
| 1242 | s10 | REF | 50% |
| 1243 | s10 | REF | 70% |
| 1244 | s10 | SNP | 75% |
| 1245 | s10 | SNP | 55% |
| 1246 | s10 | REF | 65% |
| 1247 | s10 | SNP | 70% |
| 1248 | s10 | REF | 65% |
| 1249 | s10 | REF | 65% |
| 1250 | s10 | REF | 60% |
| 1251 | s11 | SNP | 45% |
| 1252 | s11 | SNP | 55% |
| 1253 | s11 | REF | 50% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 1254 | s11 | SNP | 35% |
| 1255 | s11 | REF | 55% |
| 1256 | s11 | SNP | 60% |
| 1257 | s11 | SNP | 35% |
| 1258 | s11 | SNP | 55% |
| 1259 | s11 | REF | 50% |
| 1260 | s11 | SNP | 35% |
| 1261 | s11 | SNP | 35% |
| 1262 | s11 | SNP | 40% |
| 1263 | s11 | SNP | 60% |
| 1264 | s11 | SNP | 35% |
| 1265 | s11 | SNP | 55% |
| 1266 | s11 | REF | 45% |
| 1267 | s11 | SNP | 50% |
| 1268 | s11 | REF | 60% |
| 1269 | s11 | SNP | 65% |
| 1270 | s11 | REF | 50% |
| 1271 | s11 | SNP | 55% |
| 1272 | s11 | REF | 55% |
| 1273 | s11 | SNP | 40% |
| 1274 | s11 | REF | 35% |
| 1275 | s11 | SNP | 35% |
| 1276 | s11 | SNP | 40% |
| 1277 | s11 | SNP | 65% |
| 1278 | s11 | REF | 60% |
| 1279 | s11 | REF | 55% |
| 1280 | s11 | SNP | 60% |
| 1281 | s11 | SNP | 35% |
| 1282 | s11 | SNP | 50% |
| 1283 | s11 | REF | 45% |
| 1284 | s11 | REF | 50% |
| 1285 | s11 | SNP | 55% |
| 1286 | s11 | SNP | 35% |
| 1287 | s11 | REF | 45% |
| 1288 | s11 | SNP | 50% |
| 1289 | s11 | SNP | 55% |
| 1290 | s11 | SNP | 35% |
| 1291 | s11 | SNP | 60% |
| 1292 | s11 | REF | 55% |
| 1293 | s11 | REF | 50% |
| 1294 | s11 | SNP | 35% |
| 1295 | s11 | SNP | 35% |
| 1296 | s11 | SNP | 35% |
| 1297 | s12 | SNP | 50% |
| 1298 | s12 | SNP | 55% |
| 1299 | s12 | SNP | 45% |
| 1300 | s12 | REF | 45% |
| 1301 | s12 | SNP | 50% |
| 1302 | s12 | REF | 50% |
| 1303 | s12 | SNP | 50% |
| 1304 | s12 | REF | 50% |
| 1305 | s12 | REF | 45% |
| 1306 | s12 | SNP | 45% |
| 1307 | s12 | REF | 50% |
| 1308 | s12 | REF | 35% |
| 1309 | s12 | REF | 35% |
| 1310 | s12 | REF | 50% |
| 1311 | s12 | SNP | 50% |
| 1312 | s12 | REF | 40% |
| 1313 | s12 | REF | 55% |
| 1314 | s12 | SNP | 55% |
| 1315 | s12 | SNP | 50% |
| 1316 | s12 | REF | 50% |
| 1317 | s12 | SNP | 50% |
| 1318 | s12 | SNP | 55% |
| 1319 | s12 | REF | 55% |
| 1320 | s12 | REF | 50% |
| 1321 | s12 | SNP | 50% |
| 1322 | s12 | REF | 50% |
| 1323 | s12 | REF | 50% |
| 1324 | s12 | REF | 55% |
| 1325 | s12 | SNP | 55% |
| 1326 | s12 | SNP | 40% |
| 1327 | s12 | REF | 40% |
| 1328 | s12 | REF | 45% |
| 1329 | s12 | REF | 50% |
| 1330 | s12 | SNP | 50% |
| 1331 | s12 | REF | 35% |
| 1332 | s12 | SNP | 40% |
| 1333 | s12 | REF | 40% |
| 1334 | s12 | SNP | 45% |
| 1335 | s12 | REF | 45% |
| 1336 | s12 | REF | 55% |
| 1337 | s12 | REF | 50% |
| 1338 | s12 | SNP | 50% |
| 1339 | s12 | SNP | 50% |
| 1340 | s12 | REF | 50% |
| 1341 | s12 | REF | 35% |
| 1342 | s12 | SNP | 40% |
| 1343 | s12 | REF | 40% |
| 1344 | s12 | REF | 50% |
| 1345 | s12 | REF | 35% |
| 1346 | s12 | SNP | 35% |
| 1347 | s13 | REF | 40% |
| 1348 | s13 | REF | 40% |
| 1349 | s13 | SNP | 45% |
| 1350 | s13 | SNP | 35% |
| 1351 | s13 | REF | 40% |
| 1352 | s13 | SNP | 45% |
| 1353 | s13 | SNP | 45% |
| 1354 | s13 | SNP | 35% |
| 1355 | s13 | SNP | 35% |
| 1356 | s13 | REF | 35% |
| 1357 | s13 | SNP | 40% |
| 1358 | s13 | SNP | 35% |
| 1359 | s14 | SNP | 65% |
| 1360 | s14 | SNP | 60% |
| 1361 | s14 | REF | 70% |
| 1362 | s14 | REF | 55% |
| 1363 | s14 | SNP | 60% |
| 1364 | s14 | SNP | 70% |
| 1365 | s14 | REF | 65% |
| 1366 | s14 | REF | 60% |
| 1367 | s14 | SNP | 65% |
| 1368 | s14 | SNP | 65% |
| 1369 | s14 | SNP | 55% |
| 1370 | s14 | REF | 50% |
| 1371 | s14 | REF | 70% |
| 1372 | s14 | SNP | 75% |
| 1373 | s14 | REF | 50% |
| 1374 | s14 | REF | 60% |
| 1375 | s14 | SNP | 65% |
| 1376 | s14 | SNP | 75% |
| 1377 | s14 | SNP | 60% |
| 1378 | s14 | SNP | 65% |
| 1379 | s14 | SNP | 55% |
| 1380 | s14 | SNP | 75% |
| 1381 | s14 | REF | 60% |
| 1382 | s14 | SNP | 65% |
| 1383 | s14 | REF | 60% |
| 1384 | s14 | SNP | 65% |
| 1385 | s14 | SNP | 75% |
| 1386 | s14 | SNP | 65% |
| 1387 | s14 | SNP | 65% |
| 1388 | s14 | SNP | 75% |
| 1389 | s14 | REF | 70% |
| 1390 | s14 | SNP | 70% |
| 1391 | s14 | REF | 65% |
| 1392 | s14 | REF | 70% |
| 1393 | s14 | SNP | 75% |
| 1394 | s14 | SNP | 70% |
| 1395 | s14 | SNP | 70% |
| 1396 | s14 | REF | 65% |
| 1397 | s14 | REF | 70% |
| 1398 | s14 | REF | 65% |
| 1399 | s14 | SNP | 70% |
| 1400 | s14 | SNP | 65% |
| 1401 | s14 | REF | 60% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 1402 | s14 | SNP | 55% |
| 1403 | s14 | SNP | 60% |
| 1404 | s14 | REF | 55% |
| 1405 | s14 | SNP | 65% |
| 1406 | s14 | REF | 60% |
| 1407 | s14 | REF | 70% |
| 1408 | s14 | SNP | 75% |
| 1409 | s14 | REF | 60% |
| 1410 | s14 | SNP | 65% |
| 1411 | s14 | REF | 70% |
| 1412 | s14 | SNP | 65% |
| 1413 | s14 | REF | 60% |
| 1414 | s14 | SNP | 70% |
| 1415 | s72 | SNP | 35% |
| 1416 | s15 | REF | 50% |
| 1417 | s15 | SNP | 55% |
| 1418 | s15 | REF | 55% |
| 1419 | s15 | SNP | 60% |
| 1420 | s15 | SNP | 50% |
| 1421 | s15 | REF | 45% |
| 1422 | s15 | REF | 45% |
| 1423 | s15 | SNP | 50% |
| 1424 | s15 | REF | 40% |
| 1425 | s15 | SNP | 45% |
| 1426 | s15 | REF | 35% |
| 1427 | s15 | REF | 50% |
| 1428 | s15 | SNP | 55% |
| 1429 | s15 | REF | 45% |
| 1430 | s15 | SNP | 50% |
| 1431 | s15 | SNP | 40% |
| 1432 | s15 | SNP | 40% |
| 1433 | s15 | REF | 40% |
| 1434 | s15 | SNP | 45% |
| 1435 | s15 | SNP | 45% |
| 1436 | s15 | REF | 60% |
| 1437 | s15 | SNP | 65% |
| 1438 | s15 | SNP | 50% |
| 1439 | s15 | REF | 45% |
| 1440 | s15 | SNP | 65% |
| 1441 | s15 | REF | 60% |
| 1442 | s15 | REF | 40% |
| 1443 | s15 | SNP | 60% |
| 1444 | s15 | SNP | 55% |
| 1445 | s15 | REF | 50% |
| 1446 | s15 | SNP | 35% |
| 1447 | s15 | SNP | 45% |
| 1448 | s15 | REF | 40% |
| 1449 | s15 | SNP | 60% |
| 1450 | s15 | REF | 55% |
| 1451 | s15 | REF | 40% |
| 1452 | s15 | SNP | 45% |
| 1453 | s15 | REF | 50% |
| 1454 | s15 | SNP | 55% |
| 1455 | s15 | REF | 45% |
| 1456 | s15 | SNP | 50% |
| 1457 | s15 | REF | 40% |
| 1458 | s15 | SNP | 45% |
| 1459 | s15 | REF | 35% |
| 1460 | s15 | SNP | 40% |
| 1461 | s15 | SNP | 60% |
| 1462 | s15 | REF | 55% |
| 1463 | s15 | REF | 35% |
| 1464 | s15 | SNP | 45% |
| 1465 | s15 | REF | 40% |
| 1466 | s15 | SNP | 60% |
| 1467 | s15 | REF | 55% |
| 1468 | s15 | REF | 35% |
| 1469 | s15 | SNP | 40% |
| 1470 | s15 | SNP | 60% |
| 1471 | s15 | REF | 55% |
| 1472 | s15 | SNP | 55% |
| 1473 | s15 | REF | 50% |
| 1474 | s16 | SNP | 75% |
| 1475 | s16 | REF | 80% |
| 1476 | s16 | REF | 85% |
| 1477 | s16 | SNP | 80% |
| 1478 | s16 | SNP | 80% |
| 1479 | s16 | SNP | 80% |
| 1480 | s16 | REF | 85% |
| 1481 | s16 | SNP | 65% |
| 1482 | s16 | REF | 70% |
| 1483 | s16 | SNP | 70% |
| 1484 | s16 | REF | 75% |
| 1485 | s16 | REF | 85% |
| 1486 | s16 | SNP | 80% |
| 1487 | s16 | REF | 85% |
| 1488 | s16 | SNP | 80% |
| 1489 | s16 | REF | 80% |
| 1490 | s16 | SNP | 75% |
| 1491 | s16 | REF | 75% |
| 1492 | s16 | SNP | 70% |
| 1493 | s16 | REF | 70% |
| 1494 | s16 | SNP | 65% |
| 1495 | s16 | REF | 75% |
| 1496 | s16 | SNP | 70% |
| 1497 | s16 | REF | 75% |
| 1498 | s16 | SNP | 65% |
| 1499 | s16 | REF | 70% |
| 1500 | s16 | SNP | 70% |
| 1501 | s16 | REF | 75% |
| 1502 | s16 | REF | 85% |
| 1503 | s16 | SNP | 70% |
| 1504 | s16 | SNP | 80% |
| 1505 | s16 | REF | 90% |
| 1506 | s16 | SNP | 85% |
| 1507 | s16 | REF | 70% |
| 1508 | s16 | REF | 85% |
| 1509 | s16 | REF | 80% |
| 1510 | s16 | SNP | 80% |
| 1511 | s16 | REF | 70% |
| 1512 | s16 | SNP | 65% |
| 1513 | s16 | SNP | 65% |
| 1514 | s17 | REF | 45% |
| 1515 | s17 | SNP | 45% |
| 1516 | s17 | SNP | 45% |
| 1517 | s17 | REF | 45% |
| 1518 | s17 | SNP | 40% |
| 1519 | s17 | SNP | 50% |
| 1520 | s17 | SNP | 50% |
| 1521 | s17 | REF | 45% |
| 1522 | s17 | REF | 45% |
| 1523 | s17 | SNP | 45% |
| 1524 | s17 | SNP | 45% |
| 1525 | s17 | SNP | 55% |
| 1526 | s17 | REF | 50% |
| 1527 | s17 | SNP | 70% |
| 1528 | s17 | SNP | 45% |
| 1529 | s17 | SNP | 45% |
| 1530 | s17 | SNP | 45% |
| 1531 | s17 | REF | 55% |
| 1532 | s17 | SNP | 45% |
| 1533 | s17 | SNP | 45% |
| 1534 | s17 | REF | 60% |
| 1535 | s17 | SNP | 65% |
| 1536 | s17 | REF | 60% |
| 1537 | s17 | SNP | 65% |
| 1538 | s17 | REF | 65% |
| 1539 | s17 | SNP | 70% |
| 1540 | s17 | REF | 70% |
| 1541 | s17 | REF | 60% |
| 1542 | s17 | REF | 45% |
| 1543 | s17 | SNP | 45% |
| 1544 | s17 | SNP | 65% |
| 1545 | s17 | REF | 65% |
| 1546 | s17 | SNP | 45% |
| 1547 | s17 | REF | 55% |
| 1548 | s17 | SNP | 45% |
| 1549 | s17 | REF | 40% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 1550 | s17 | REF | 60% |
| 1551 | s17 | SNP | 40% |
| 1552 | s17 | SNP | 55% |
| 1553 | s17 | REF | 50% |
| 1554 | s17 | SNP | 45% |
| 1555 | s18 | REF | 60% |
| 1556 | s18 | SNP | 65% |
| 1557 | s18 | REF | 55% |
| 1558 | s18 | SNP | 60% |
| 1559 | s18 | REF | 65% |
| 1560 | s18 | SNP | 70% |
| 1561 | s18 | REF | 65% |
| 1562 | s18 | SNP | 70% |
| 1563 | s18 | REF | 55% |
| 1564 | s18 | REF | 65% |
| 1565 | s18 | SNP | 70% |
| 1566 | s18 | REF | 60% |
| 1567 | s18 | SNP | 65% |
| 1568 | s18 | REF | 60% |
| 1569 | s18 | SNP | 65% |
| 1570 | s18 | SNP | 70% |
| 1571 | s18 | SNP | 65% |
| 1572 | s18 | SNP | 65% |
| 1573 | s18 | SNP | 70% |
| 1574 | s18 | REF | 60% |
| 1575 | s18 | SNP | 75% |
| 1576 | s18 | REF | 70% |
| 1577 | s18 | REF | 70% |
| 1578 | s18 | SNP | 75% |
| 1579 | s18 | REF | 55% |
| 1580 | s18 | SNP | 60% |
| 1581 | s18 | SNP | 75% |
| 1582 | s18 | REF | 70% |
| 1583 | s18 | SNP | 70% |
| 1584 | s18 | REF | 65% |
| 1585 | s18 | SNP | 60% |
| 1586 | s18 | SNP | 75% |
| 1587 | s18 | REF | 70% |
| 1588 | s18 | SNP | 60% |
| 1589 | s18 | REF | 65% |
| 1590 | s18 | SNP | 70% |
| 1591 | s18 | SNP | 65% |
| 1592 | s18 | REF | 60% |
| 1593 | s18 | SNP | 65% |
| 1594 | s18 | REF | 60% |
| 1595 | s18 | REF | 60% |
| 1596 | s18 | SNP | 65% |
| 1597 | s18 | REF | 60% |
| 1598 | s18 | SNP | 70% |
| 1599 | s18 | REF | 65% |
| 1600 | s18 | SNP | 70% |
| 1601 | s18 | REF | 65% |
| 1602 | s18 | SNP | 65% |
| 1603 | s18 | REF | 60% |
| 1604 | s18 | SNP | 65% |
| 1605 | s18 | REF | 60% |
| 1606 | s18 | SNP | 65% |
| 1607 | s18 | REF | 60% |
| 1608 | s37 | SNP | 40% |
| 1609 | s37 | SNP | 35% |
| 1610 | s37 | SNP | 45% |
| 1611 | s19 | REF | 45% |
| 1612 | s19 | SNP | 45% |
| 1613 | s19 | SNP | 55% |
| 1614 | s19 | REF | 55% |
| 1615 | s19 | REF | 55% |
| 1616 | s19 | SNP | 55% |
| 1617 | s19 | SNP | 45% |
| 1618 | s19 | REF | 45% |
| 1619 | s19 | SNP | 55% |
| 1620 | s19 | REF | 55% |
| 1621 | s19 | SNP | 50% |
| 1622 | s19 | REF | 55% |
| 1623 | s19 | SNP | 55% |
| 1624 | s19 | REF | 55% |
| 1625 | s19 | SNP | 55% |
| 1626 | s19 | REF | 50% |
| 1627 | s19 | SNP | 50% |
| 1628 | s19 | SNP | 55% |
| 1629 | s19 | REF | 55% |
| 1630 | s19 | SNP | 50% |
| 1631 | s19 | REF | 50% |
| 1632 | s19 | REF | 55% |
| 1633 | s19 | REF | 60% |
| 1634 | s19 | REF | 50% |
| 1635 | s19 | SNP | 50% |
| 1636 | s19 | SNP | 55% |
| 1637 | s19 | REF | 55% |
| 1638 | s19 | SNP | 45% |
| 1639 | s19 | REF | 45% |
| 1640 | s19 | SNP | 55% |
| 1641 | s19 | REF | 55% |
| 1642 | s19 | SNP | 55% |
| 1643 | s19 | REF | 50% |
| 1644 | s19 | SNP | 50% |
| 1645 | s19 | REF | 55% |
| 1646 | s19 | SNP | 55% |
| 1647 | s19 | SNP | 50% |
| 1648 | s19 | SNP | 50% |
| 1649 | s19 | REF | 50% |
| 1650 | s19 | SNP | 45% |
| 1651 | s19 | REF | 45% |
| 1652 | s19 | REF | 50% |
| 1653 | s19 | SNP | 50% |
| 1654 | s19 | REF | 55% |
| 1655 | s19 | SNP | 50% |
| 1656 | s19 | REF | 50% |
| 1657 | s19 | SNP | 55% |
| 1658 | s19 | SNP | 45% |
| 1659 | s19 | REF | 45% |
| 1660 | s19 | SNP | 45% |
| 1661 | s20 | SNP | 70% |
| 1662 | s20 | REF | 65% |
| 1663 | s20 | REF | 65% |
| 1664 | s20 | SNP | 70% |
| 1665 | s20 | REF | 65% |
| 1666 | s20 | SNP | 70% |
| 1667 | s20 | SNP | 70% |
| 1668 | s20 | REF | 65% |
| 1669 | s20 | REF | 70% |
| 1670 | s20 | SNP | 75% |
| 1671 | s20 | REF | 65% |
| 1672 | s20 | SNP | 65% |
| 1673 | s20 | SNP | 70% |
| 1674 | s20 | REF | 65% |
| 1675 | s20 | REF | 65% |
| 1676 | s20 | SNP | 70% |
| 1677 | s20 | SNP | 75% |
| 1678 | s20 | REF | 70% |
| 1679 | s20 | SNP | 65% |
| 1680 | s20 | REF | 60% |
| 1681 | s20 | SNP | 65% |
| 1682 | s20 | REF | 60% |
| 1683 | s20 | SNP | 70% |
| 1684 | s20 | REF | 65% |
| 1685 | s20 | REF | 65% |
| 1686 | s20 | SNP | 70% |
| 1687 | s20 | SNP | 70% |
| 1688 | s20 | REF | 65% |
| 1689 | s20 | REF | 65% |
| 1690 | s20 | SNP | 70% |
| 1691 | s20 | SNP | 70% |
| 1692 | s20 | REF | 65% |
| 1693 | s20 | SNP | 75% |
| 1694 | s20 | REF | 70% |
| 1695 | s20 | SNP | 70% |
| 1696 | s20 | REF | 65% |
| 1697 | s20 | REF | 65% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 1698 | s20 | SNP | 70% |
| 1699 | s20 | REF | 70% |
| 1700 | s20 | SNP | 75% |
| 1701 | s20 | REF | 65% |
| 1702 | s20 | SNP | 70% |
| 1703 | s20 | REF | 65% |
| 1704 | s20 | SNP | 70% |
| 1705 | s20 | REF | 65% |
| 1706 | s20 | SNP | 65% |
| 1707 | s20 | REF | 60% |
| 1708 | s20 | SNP | 65% |
| 1709 | s20 | REF | 60% |
| 1710 | s20 | REF | 65% |
| 1711 | s20 | SNP | 70% |
| 1712 | s20 | REF | 65% |
| 1713 | s20 | REF | 65% |
| 1714 | s20 | SNP | 70% |
| 1715 | s20 | REF | 60% |
| 1716 | s20 | SNP | 65% |
| 1717 | s21 | REF | 40% |
| 1718 | s21 | SNP | 45% |
| 1719 | s21 | REF | 60% |
| 1720 | s21 | SNP | 50% |
| 1721 | s21 | REF | 55% |
| 1722 | s21 | SNP | 60% |
| 1723 | s21 | REF | 45% |
| 1724 | s21 | SNP | 50% |
| 1725 | s21 | REF | 45% |
| 1726 | s21 | SNP | 50% |
| 1727 | s21 | SNP | 50% |
| 1728 | s21 | REF | 50% |
| 1729 | s21 | SNP | 55% |
| 1730 | s21 | REF | 50% |
| 1731 | s21 | SNP | 55% |
| 1732 | s21 | SNP | 55% |
| 1733 | s21 | REF | 50% |
| 1734 | s21 | SNP | 55% |
| 1735 | s21 | REF | 50% |
| 1736 | s21 | SNP | 55% |
| 1737 | s21 | REF | 50% |
| 1738 | s21 | SNP | 50% |
| 1739 | s21 | REF | 45% |
| 1740 | s21 | REF | 45% |
| 1741 | s21 | SNP | 50% |
| 1742 | s21 | REF | 45% |
| 1743 | s21 | SNP | 50% |
| 1744 | s21 | SNP | 50% |
| 1745 | s21 | SNP | 65% |
| 1746 | s21 | SNP | 60% |
| 1747 | s21 | REF | 55% |
| 1748 | s21 | SNP | 50% |
| 1749 | s21 | REF | 45% |
| 1750 | s21 | REF | 45% |
| 1751 | s21 | SNP | 50% |
| 1752 | s21 | SNP | 50% |
| 1753 | s21 | SNP | 65% |
| 1754 | s21 | REF | 60% |
| 1755 | s21 | REF | 45% |
| 1756 | s21 | SNP | 50% |
| 1757 | s21 | SNP | 50% |
| 1758 | s21 | REF | 45% |
| 1759 | s21 | REF | 45% |
| 1760 | s21 | REF | 45% |
| 1761 | s21 | SNP | 50% |
| 1762 | s21 | REF | 45% |
| 1763 | s21 | REF | 60% |
| 1764 | s21 | REF | 50% |
| 1765 | s21 | SNP | 55% |
| 1766 | s21 | SNP | 55% |
| 1767 | s21 | REF | 50% |
| 1768 | s21 | REF | 40% |
| 1769 | s21 | SNP | 45% |
| 1770 | s21 | SNP | 65% |
| 1771 | s21 | SNP | 50% |
| 1772 | s21 | REF | 45% |
| 1773 | s21 | SNP | 65% |
| 1774 | s21 | REF | 60% |
| 1775 | s21 | SNP | 45% |
| 1776 | s21 | REF | 40% |
| 1777 | s21 | SNP | 50% |
| 1778 | s21 | REF | 45% |
| 1779 | s21 | REF | 45% |
| 1780 | s21 | SNP | 50% |
| 1781 | s21 | REF | 45% |
| 1782 | s21 | SNP | 50% |
| 1783 | s22 | REF | 55% |
| 1784 | s22 | REF | 50% |
| 1785 | s22 | SNP | 45% |
| 1786 | s22 | SNP | 40% |
| 1787 | s22 | REF | 45% |
| 1788 | s22 | REF | 45% |
| 1789 | s22 | REF | 55% |
| 1790 | s22 | SNP | 50% |
| 1791 | s22 | SNP | 40% |
| 1792 | s22 | REF | 50% |
| 1793 | s22 | SNP | 50% |
| 1794 | s22 | SNP | 50% |
| 1795 | s22 | REF | 55% |
| 1796 | s22 | SNP | 45% |
| 1797 | s22 | REF | 50% |
| 1798 | s22 | REF | 45% |
| 1799 | s22 | SNP | 40% |
| 1800 | s22 | SNP | 50% |
| 1801 | s22 | REF | 55% |
| 1802 | s22 | SNP | 50% |
| 1803 | s22 | REF | 55% |
| 1804 | s22 | REF | 55% |
| 1805 | s22 | REF | 55% |
| 1806 | s22 | SNP | 50% |
| 1807 | s22 | REF | 55% |
| 1808 | s22 | SNP | 50% |
| 1809 | s22 | SNP | 50% |
| 1810 | s22 | REF | 55% |
| 1811 | s22 | REF | 45% |
| 1812 | s22 | SNP | 40% |
| 1813 | s22 | REF | 55% |
| 1814 | s22 | SNP | 50% |
| 1815 | s22 | REF | 50% |
| 1816 | s22 | SNP | 45% |
| 1817 | s22 | REF | 55% |
| 1818 | s22 | SNP | 50% |
| 1819 | s22 | REF | 55% |
| 1820 | s22 | SNP | 50% |
| 1821 | s22 | SNP | 50% |
| 1822 | s22 | REF | 55% |
| 1823 | s22 | SNP | 45% |
| 1824 | s22 | REF | 50% |
| 1825 | s22 | SNP | 40% |
| 1826 | s22 | REF | 45% |
| 1827 | s22 | SNP | 40% |
| 1828 | s22 | REF | 45% |
| 1829 | s22 | SNP | 45% |
| 1830 | s22 | SNP | 50% |
| 1831 | s22 | REF | 55% |
| 1832 | s22 | REF | 50% |
| 1833 | s22 | REF | 50% |
| 1834 | s22 | REF | 55% |
| 1835 | s22 | SNP | 50% |
| 1836 | s22 | REF | 50% |
| 1837 | s22 | REF | 45% |
| 1838 | s22 | SNP | 50% |
| 1839 | s22 | REF | 55% |
| 1840 | s22 | SNP | 45% |
| 1841 | s22 | SNP | 40% |
| 1842 | s22 | REF | 45% |
| 1843 | s22 | SNP | 50% |
| 1844 | s22 | REF | 55% |
| 1845 | s23 | SNP | 55% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 1846 | s23 | SNP | 60% |
| 1847 | s23 | SNP | 50% |
| 1848 | s23 | REF | 55% |
| 1849 | s23 | SNP | 60% |
| 1850 | s23 | REF | 65% |
| 1851 | s23 | SNP | 45% |
| 1852 | s23 | REF | 50% |
| 1853 | s23 | SNP | 70% |
| 1854 | s23 | REF | 65% |
| 1855 | s23 | SNP | 60% |
| 1856 | s23 | REF | 60% |
| 1857 | s23 | SNP | 55% |
| 1858 | s23 | SNP | 55% |
| 1859 | s23 | REF | 50% |
| 1860 | s23 | SNP | 45% |
| 1861 | s23 | REF | 65% |
| 1862 | s23 | SNP | 60% |
| 1863 | s23 | REF | 65% |
| 1864 | s23 | SNP | 60% |
| 1865 | s23 | REF | 65% |
| 1866 | s23 | SNP | 60% |
| 1867 | s23 | SNP | 65% |
| 1868 | s23 | SNP | 60% |
| 1869 | s23 | REF | 65% |
| 1870 | s23 | SNP | 60% |
| 1871 | s23 | REF | 65% |
| 1872 | s23 | SNP | 55% |
| 1873 | s23 | SNP | 50% |
| 1874 | s23 | REF | 55% |
| 1875 | s23 | SNP | 60% |
| 1876 | s23 | REF | 65% |
| 1877 | s23 | SNP | 50% |
| 1878 | s23 | REF | 55% |
| 1879 | s23 | REF | 55% |
| 1880 | s23 | SNP | 50% |
| 1881 | s23 | SNP | 55% |
| 1882 | s23 | REF | 60% |
| 1883 | s23 | REF | 55% |
| 1884 | s23 | SNP | 50% |
| 1885 | s23 | REF | 60% |
| 1886 | s23 | SNP | 55% |
| 1887 | s23 | REF | 65% |
| 1888 | s23 | SNP | 60% |
| 1889 | s23 | REF | 65% |
| 1890 | s23 | SNP | 60% |
| 1891 | s23 | REF | 60% |
| 1892 | s23 | REF | 65% |
| 1893 | s23 | SNP | 60% |
| 1894 | s23 | SNP | 60% |
| 1895 | s23 | REF | 55% |
| 1896 | s23 | SNP | 55% |
| 1897 | s23 | SNP | 50% |
| 1898 | s39 | SNP | 75% |
| 1899 | s39 | SNP | 60% |
| 1900 | s39 | SNP | 70% |
| 1901 | s39 | SNP | 70% |
| 1902 | s39 | SNP | 70% |
| 1903 | s39 | SNP | 65% |
| 1904 | s39 | SNP | 70% |
| 1905 | s39 | SNP | 70% |
| 1906 | s39 | SNP | 70% |
| 1907 | s39 | SNP | 70% |
| 1908 | s39 | SNP | 75% |
| 1909 | s39 | SNP | 70% |
| 1910 | s39 | SNP | 75% |
| 1911 | s39 | SNP | 70% |
| 1912 | s39 | SNP | 70% |
| 1913 | s39 | SNP | 70% |
| 1914 | s39 | SNP | 70% |
| 1915 | s39 | SNP | 70% |
| 1916 | s39 | SNP | 70% |
| 1917 | s39 | SNP | 70% |
| 1918 | s39 | SNP | 70% |
| 1919 | s39 | SNP | 75% |
| 1920 | s39 | SNP | 70% |
| 1921 | s39 | SNP | 60% |
| 1922 | s39 | SNP | 70% |
| 1923 | s39 | SNP | 65% |
| 1924 | s39 | SNP | 70% |
| 1925 | s39 | SNP | 70% |
| 1926 | s39 | SNP | 70% |
| 1927 | s39 | SNP | 70% |
| 1928 | s38 | SNP | 35% |
| 1929 | s38 | SNP | 45% |
| 1930 | s38 | SNP | 45% |
| 1931 | s24 | REF | 60% |
| 1932 | s24 | SNP | 55% |
| 1933 | s24 | SNP | 55% |
| 1934 | s24 | SNP | 55% |
| 1935 | s24 | REF | 60% |
| 1936 | s24 | SNP | 55% |
| 1937 | s24 | REF | 65% |
| 1938 | s24 | SNP | 60% |
| 1939 | s24 | SNP | 55% |
| 1940 | s24 | REF | 60% |
| 1941 | s24 | SNP | 60% |
| 1942 | s24 | REF | 65% |
| 1943 | s24 | SNP | 60% |
| 1944 | s24 | SNP | 55% |
| 1945 | s24 | REF | 60% |
| 1946 | s24 | SNP | 60% |
| 1947 | s24 | SNP | 60% |
| 1948 | s24 | REF | 65% |
| 1949 | s24 | SNP | 60% |
| 1950 | s24 | SNP | 70% |
| 1951 | s24 | SNP | 70% |
| 1952 | s24 | SNP | 60% |
| 1953 | s24 | SNP | 60% |
| 1954 | s24 | SNP | 70% |
| 1955 | s24 | REF | 65% |
| 1956 | s24 | SNP | 60% |
| 1957 | s24 | REF | 65% |
| 1958 | s24 | SNP | 70% |
| 1959 | s24 | REF | 60% |
| 1960 | s24 | REF | 65% |
| 1961 | s24 | SNP | 60% |
| 1962 | s24 | SNP | 55% |
| 1963 | s24 | SNP | 55% |
| 1964 | s24 | SNP | 65% |
| 1965 | s24 | SNP | 60% |
| 1966 | s25 | SNP | 40% |
| 1967 | s25 | SNP | 60% |
| 1968 | s25 | REF | 65% |
| 1969 | s25 | SNP | 45% |
| 1970 | s25 | REF | 50% |
| 1971 | s25 | REF | 70% |
| 1972 | s25 | SNP | 50% |
| 1973 | s25 | REF | 55% |
| 1974 | s25 | REF | 45% |
| 1975 | s25 | REF | 50% |
| 1976 | s25 | SNP | 45% |
| 1977 | s25 | SNP | 45% |
| 1978 | s25 | REF | 55% |
| 1979 | s25 | SNP | 50% |
| 1980 | s25 | SNP | 65% |
| 1981 | s25 | SNP | 65% |
| 1982 | s25 | REF | 70% |
| 1983 | s25 | SNP | 50% |
| 1984 | s25 | REF | 55% |
| 1985 | s25 | SNP | 55% |
| 1986 | s25 | REF | 60% |
| 1987 | s25 | REF | 50% |
| 1988 | s25 | SNP | 45% |
| 1989 | s25 | REF | 60% |
| 1990 | s25 | SNP | 55% |
| 1991 | s25 | SNP | 60% |
| 1992 | s25 | REF | 65% |
| 1993 | s25 | SNP | 60% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 1994 | s25 | REF | 65% |
| 1995 | s25 | SNP | 50% |
| 1996 | s25 | REF | 55% |
| 1997 | s25 | SNP | 45% |
| 1998 | s25 | REF | 50% |
| 1999 | s25 | SNP | 70% |
| 2000 | s25 | REF | 75% |
| 2001 | s25 | SNP | 45% |
| 2002 | s25 | REF | 50% |
| 2003 | s25 | REF | 55% |
| 2004 | s25 | SNP | 50% |
| 2005 | s25 | REF | 65% |
| 2006 | s25 | SNP | 60% |
| 2007 | s25 | SNP | 55% |
| 2008 | s25 | REF | 60% |
| 2009 | s25 | REF | 70% |
| 2010 | s25 | SNP | 60% |
| 2011 | s25 | REF | 65% |
| 2012 | s25 | SNP | 65% |
| 2013 | s25 | SNP | 65% |
| 2014 | s25 | REF | 70% |
| 2015 | s25 | REF | 50% |
| 2016 | s25 | REF | 55% |
| 2017 | s25 | SNP | 50% |
| 2018 | s25 | REF | 50% |
| 2019 | s25 | SNP | 45% |
| 2020 | s25 | REF | 60% |
| 2021 | s25 | SNP | 55% |
| 2022 | s26 | SNP | 35% |
| 2023 | s26 | SNP | 35% |
| 2024 | s26 | REF | 35% |
| 2025 | s26 | SNP | 35% |
| 2026 | s26 | REF | 35% |
| 2027 | s26 | SNP | 35% |
| 2028 | s26 | REF | 35% |
| 2029 | s26 | REF | 35% |
| 2030 | s26 | SNP | 40% |
| 2031 | s26 | REF | 40% |
| 2032 | s26 | REF | 35% |
| 2033 | s26 | REF | 35% |
| 2034 | s26 | REF | 35% |
| 2035 | s26 | REF | 35% |
| 2036 | s26 | REF | 35% |
| 2037 | s26 | REF | 40% |
| 2038 | s26 | SNP | 40% |
| 2039 | s26 | REF | 40% |
| 2040 | s26 | REF | 35% |
| 2041 | s26 | SNP | 40% |
| 2042 | s26 | REF | 40% |
| 2043 | s26 | REF | 40% |
| 2044 | s26 | SNP | 40% |
| 2045 | s26 | REF | 40% |
| 2046 | s26 | REF | 35% |
| 2047 | s26 | REF | 40% |
| 2048 | s26 | SNP | 40% |
| 2049 | s26 | REF | 40% |
| 2050 | s26 | SNP | 35% |
| 2051 | s26 | REF | 35% |
| 2052 | s26 | SNP | 35% |
| 2053 | s26 | REF | 35% |
| 2054 | s26 | REF | 35% |
| 2055 | s26 | SNP | 35% |
| 2056 | s26 | REF | 35% |
| 2057 | s26 | SNP | 35% |
| 2058 | s26 | REF | 35% |
| 2059 | s73 | SNP | 35% |
| 2060 | s73 | SNP | 40% |
| 2061 | s73 | SNP | 40% |
| 2062 | s6 | SNP | 35% |
| 2063 | s27 | REF | 75% |
| 2064 | s27 | SNP | 80% |
| 2065 | s27 | REF | 75% |
| 2066 | s27 | SNP | 80% |
| 2067 | s27 | REF | 75% |
| 2068 | s27 | SNP | 80% |
| 2069 | s27 | REF | 75% |
| 2070 | s27 | SNP | 80% |
| 2071 | s27 | REF | 80% |
| 2072 | s27 | SNP | 85% |
| 2073 | s27 | SNP | 85% |
| 2074 | s27 | REF | 80% |
| 2075 | s27 | SNP | 85% |
| 2076 | s27 | REF | 80% |
| 2077 | s27 | REF | 80% |
| 2078 | s27 | REF | 80% |
| 2079 | s27 | SNP | 85% |
| 2080 | s27 | SNP | 85% |
| 2081 | s27 | REF | 80% |
| 2082 | s27 | SNP | 80% |
| 2083 | s27 | SNP | 80% |
| 2084 | s27 | REF | 75% |
| 2085 | s27 | REF | 80% |
| 2086 | s27 | SNP | 85% |
| 2087 | s27 | REF | 75% |
| 2088 | s27 | SNP | 80% |
| 2089 | s27 | REF | 80% |
| 2090 | s27 | SNP | 85% |
| 2091 | s27 | SNP | 80% |
| 2092 | s27 | SNP | 85% |
| 2093 | s27 | REF | 80% |
| 2094 | s27 | SNP | 80% |
| 2095 | s27 | REF | 75% |
| 2096 | s27 | REF | 80% |
| 2097 | s27 | SNP | 85% |
| 2098 | s27 | SNP | 85% |
| 2099 | s27 | REF | 80% |
| 2100 | s27 | SNP | 85% |
| 2101 | s27 | REF | 80% |
| 2102 | s27 | SNP | 85% |
| 2103 | s27 | REF | 80% |
| 2104 | s27 | REF | 75% |
| 2105 | s27 | SNP | 80% |
| 2106 | s27 | REF | 75% |
| 2107 | s27 | SNP | 80% |
| 2108 | s27 | REF | 75% |
| 2109 | s27 | SNP | 85% |
| 2110 | s27 | REF | 80% |
| 2111 | s27 | REF | 75% |
| 2112 | s4 | SNP | 40% |
| 2113 | s4 | SNP | 45% |
| 2114 | s4 | SNP | 50% |
| 2115 | s4 | SNP | 50% |
| 2116 | s4 | SNP | 55% |
| 2117 | s4 | SNP | 40% |
| 2118 | s4 | SNP | 35% |
| 2119 | s4 | SNP | 45% |
| 2120 | s4 | SNP | 50% |
| 2121 | s4 | SNP | 55% |
| 2122 | s4 | SNP | 50% |
| 2123 | s28 | SNP | 60% |
| 2124 | s28 | REF | 65% |
| 2125 | s28 | REF | 70% |
| 2126 | s28 | SNP | 65% |
| 2127 | s28 | SNP | 60% |
| 2128 | s28 | REF | 65% |
| 2129 | s28 | SNP | 65% |
| 2130 | s28 | REF | 65% |
| 2131 | s28 | SNP | 65% |
| 2132 | s28 | REF | 70% |
| 2133 | s28 | SNP | 65% |
| 2134 | s28 | REF | 70% |
| 2135 | s28 | REF | 70% |
| 2136 | s28 | SNP | 65% |
| 2137 | s28 | REF | 70% |
| 2138 | s28 | SNP | 65% |
| 2139 | s28 | SNP | 65% |
| 2140 | s28 | REF | 70% |
| 2141 | s28 | SNP | 65% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 2142 | s28 | REF | 70% |
| 2143 | s28 | SNP | 65% |
| 2144 | s28 | SNP | 65% |
| 2145 | s28 | SNP | 65% |
| 2146 | s28 | REF | 70% |
| 2147 | s28 | SNP | 65% |
| 2148 | s28 | SNP | 65% |
| 2149 | s28 | SNP | 65% |
| 2150 | s28 | REF | 70% |
| 2151 | s28 | REF | 70% |
| 2152 | s28 | SNP | 65% |
| 2153 | s28 | SNP | 65% |
| 2154 | s28 | REF | 70% |
| 2155 | s28 | SNP | 70% |
| 2156 | s28 | SNP | 65% |
| 2157 | s28 | SNP | 65% |
| 2158 | s28 | REF | 70% |
| 2159 | s28 | REF | 70% |
| 2160 | s28 | SNP | 65% |
| 2161 | s28 | REF | 70% |
| 2162 | s28 | REF | 70% |
| 2163 | s28 | SNP | 65% |
| 2164 | s28 | REF | 70% |
| 2165 | s28 | REF | 65% |
| 2166 | s28 | SNP | 60% |
| 2167 | s28 | REF | 65% |
| 2168 | s28 | SNP | 65% |
| 2169 | s28 | REF | 70% |
| 2170 | s28 | REF | 70% |
| 2171 | s28 | SNP | 65% |
| 2172 | s28 | REF | 65% |
| 2173 | s28 | SNP | 60% |
| 2174 | s28 | SNP | 60% |
| 2175 | s28 | REF | 65% |
| 2176 | s28 | SNP | 60% |
| 2177 | s28 | SNP | 65% |
| 2178 | s28 | REF | 70% |
| 2179 | s28 | REF | 70% |
| 2180 | s28 | SNP | 65% |
| 2181 | s3 | SNP | 40% |
| 2182 | s3 | SNP | 45% |
| 2183 | s3 | SNP | 50% |
| 2184 | s3 | SNP | 50% |
| 2185 | s3 | SNP | 55% |
| 2186 | s3 | SNP | 40% |
| 2187 | s3 | SNP | 35% |
| 2188 | s3 | SNP | 45% |
| 2189 | s3 | SNP | 55% |
| 2190 | s3 | SNP | 50% |
| 2191 | s3 | SNP | 55% |
| 2192 | s3 | SNP | 50% |
| 2193 | s3 | SNP | 55% |
| 2194 | s30 | SNP | 35% |
| 2195 | s30 | SNP | 50% |
| 2196 | s30 | REF | 45% |
| 2197 | s30 | REF | 45% |
| 2198 | s30 | SNP | 50% |
| 2199 | s30 | SNP | 65% |
| 2200 | s30 | REF | 60% |
| 2201 | s30 | REF | 45% |
| 2202 | s30 | REF | 35% |
| 2203 | s30 | SNP | 40% |
| 2204 | s30 | REF | 60% |
| 2205 | s30 | REF | 35% |
| 2206 | s30 | SNP | 40% |
| 2207 | s30 | SNP | 50% |
| 2208 | s30 | REF | 45% |
| 2209 | s30 | SNP | 40% |
| 2210 | s30 | REF | 35% |
| 2211 | s30 | SNP | 45% |
| 2212 | s30 | REF | 40% |
| 2213 | s30 | SNP | 35% |
| 2214 | s30 | SNP | 45% |
| 2215 | s30 | REF | 40% |
| 2216 | s30 | SNP | 50% |
| 2217 | s30 | REF | 45% |
| 2218 | s30 | SNP | 65% |
| 2219 | s30 | REF | 60% |
| 2220 | s30 | SNP | 35% |
| 2221 | s30 | SNP | 60% |
| 2222 | s30 | REF | 55% |
| 2223 | s30 | REF | 50% |
| 2224 | s30 | SNP | 55% |
| 2225 | s30 | REF | 50% |
| 2226 | s30 | REF | 35% |
| 2227 | s30 | SNP | 40% |
| 2228 | s30 | REF | 35% |
| 2229 | s30 | SNP | 55% |
| 2230 | s30 | REF | 50% |
| 2231 | s30 | SNP | 65% |
| 2232 | s30 | REF | 40% |
| 2233 | s30 | SNP | 45% |
| 2234 | s30 | REF | 40% |
| 2235 | s30 | SNP | 45% |
| 2236 | s30 | REF | 60% |
| 2237 | s30 | SNP | 35% |
| 2238 | s30 | SNP | 55% |
| 2239 | s30 | REF | 50% |
| 2240 | s30 | SNP | 65% |
| 2241 | s30 | REF | 55% |
| 2242 | s30 | SNP | 60% |
| 2243 | s30 | REF | 50% |
| 2244 | s30 | SNP | 55% |
| 2245 | s31 | SNP | 75% |
| 2246 | s31 | REF | 75% |
| 2247 | s31 | SNP | 55% |
| 2248 | s31 | REF | 50% |
| 2249 | s31 | REF | 70% |
| 2250 | s31 | REF | 70% |
| 2251 | s31 | REF | 70% |
| 2252 | s31 | SNP | 55% |
| 2253 | s31 | REF | 50% |
| 2254 | s31 | SNP | 55% |
| 2255 | s31 | REF | 70% |
| 2256 | s31 | SNP | 60% |
| 2257 | s31 | REF | 55% |
| 2258 | s31 | SNP | 70% |
| 2259 | s31 | REF | 65% |
| 2260 | s31 | SNP | 70% |
| 2261 | s31 | REF | 65% |
| 2262 | s31 | REF | 65% |
| 2263 | s31 | SNP | 75% |
| 2264 | s31 | REF | 70% |
| 2265 | s31 | SNP | 65% |
| 2266 | s31 | REF | 60% |
| 2267 | s31 | SNP | 75% |
| 2268 | s31 | REF | 70% |
| 2269 | s31 | REF | 55% |
| 2270 | s31 | SNP | 70% |
| 2271 | s31 | REF | 65% |
| 2272 | s31 | SNP | 55% |
| 2273 | s31 | REF | 50% |
| 2274 | s31 | SNP | 70% |
| 2275 | s31 | REF | 65% |
| 2276 | s31 | REF | 65% |
| 2277 | s31 | SNP | 70% |
| 2278 | s31 | REF | 70% |
| 2279 | s31 | REF | 70% |
| 2280 | s31 | REF | 70% |
| 2281 | s31 | SNP | 55% |
| 2282 | s31 | SNP | 75% |
| 2283 | s31 | REF | 50% |
| 2284 | s32 | SNP | 60% |
| 2285 | s32 | SNP | 70% |
| 2286 | s32 | SNP | 60% |
| 2287 | s32 | REF | 65% |
| 2288 | s32 | SNP | 70% |
| 2289 | s32 | REF | 70% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 2290 | s32 | SNP | 65% |
| 2291 | s32 | SNP | 70% |
| 2292 | s32 | SNP | 70% |
| 2293 | s32 | REF | 70% |
| 2294 | s32 | SNP | 65% |
| 2295 | s32 | SNP | 60% |
| 2296 | s32 | REF | 65% |
| 2297 | s32 | REF | 75% |
| 2298 | s32 | SNP | 70% |
| 2299 | s32 | SNP | 70% |
| 2300 | s32 | REF | 75% |
| 2301 | s32 | SNP | 65% |
| 2302 | s32 | REF | 70% |
| 2303 | s32 | REF | 65% |
| 2304 | s32 | SNP | 70% |
| 2305 | s32 | REF | 70% |
| 2306 | s32 | SNP | 65% |
| 2307 | s32 | SNP | 70% |
| 2308 | s32 | REF | 75% |
| 2309 | s32 | SNP | 65% |
| 2310 | s32 | SNP | 65% |
| 2311 | s32 | REF | 70% |
| 2312 | s32 | REF | 65% |
| 2313 | s32 | REF | 70% |
| 2314 | s32 | SNP | 65% |
| 2315 | s32 | SNP | 65% |
| 2316 | s32 | SNP | 70% |
| 2317 | s32 | REF | 75% |
| 2318 | s32 | REF | 70% |
| 2319 | s32 | SNP | 70% |
| 2320 | s32 | REF | 75% |
| 2321 | s32 | REF | 70% |
| 2322 | s32 | SNP | 65% |
| 2323 | s32 | REF | 70% |
| 2324 | s32 | SNP | 65% |
| 2325 | s32 | SNP | 60% |
| 2326 | s32 | REF | 70% |
| 2327 | s32 | SNP | 65% |
| 2328 | s32 | SNP | 60% |
| 2329 | s32 | REF | 70% |
| 2330 | s32 | SNP | 65% |
| 2331 | s32 | REF | 65% |
| 2332 | s32 | SNP | 60% |
| 2333 | s74 | SNP | 60% |
| 2334 | s74 | SNP | 60% |
| 2335 | s74 | SNP | 65% |
| 2336 | s74 | SNP | 65% |
| 2337 | s74 | SNP | 70% |
| 2338 | s74 | SNP | 60% |
| 2339 | s74 | SNP | 60% |
| 2340 | s33 | REF | 60% |
| 2341 | s33 | SNP | 65% |
| 2342 | s33 | SNP | 40% |
| 2343 | s33 | SNP | 65% |
| 2344 | s33 | REF | 60% |
| 2345 | s33 | REF | 40% |
| 2346 | s33 | SNP | 45% |
| 2347 | s33 | REF | 35% |
| 2348 | s33 | REF | 45% |
| 2349 | s33 | SNP | 50% |
| 2350 | s33 | SNP | 50% |
| 2351 | s33 | REF | 55% |
| 2352 | s33 | SNP | 60% |
| 2353 | s33 | REF | 45% |
| 2354 | s33 | REF | 50% |
| 2355 | s33 | SNP | 55% |
| 2356 | s33 | SNP | 45% |
| 2357 | s33 | REF | 60% |
| 2358 | s33 | SNP | 65% |
| 2359 | s33 | SNP | 65% |
| 2360 | s33 | REF | 60% |
| 2361 | s33 | SNP | 60% |
| 2362 | s33 | REF | 55% |
| 2363 | s33 | SNP | 55% |
| 2364 | s33 | REF | 50% |
| 2365 | s33 | REF | 55% |
| 2366 | s33 | SNP | 60% |
| 2367 | s33 | REF | 55% |
| 2368 | s33 | SNP | 60% |
| 2369 | s33 | SNP | 60% |
| 2370 | s33 | REF | 45% |
| 2371 | s33 | SNP | 50% |
| 2372 | s33 | SNP | 50% |
| 2373 | s33 | REF | 45% |
| 2374 | s33 | REF | 50% |
| 2375 | s33 | SNP | 55% |
| 2376 | s33 | SNP | 60% |
| 2377 | s33 | REF | 55% |
| 2378 | s33 | REF | 55% |
| 2379 | s33 | SNP | 60% |
| 2380 | s33 | REF | 40% |
| 2381 | s33 | REF | 55% |
| 2382 | s33 | SNP | 60% |
| 2383 | s33 | SNP | 55% |
| 2384 | s33 | SNP | 55% |
| 2385 | s33 | REF | 50% |
| 2386 | s34 | SNP | 35% |
| 2387 | s34 | REF | 45% |
| 2388 | s34 | SNP | 40% |
| 2389 | s34 | SNP | 45% |
| 2390 | s34 | REF | 50% |
| 2391 | s34 | SNP | 40% |
| 2392 | s34 | REF | 45% |
| 2393 | s34 | SNP | 45% |
| 2394 | s34 | REF | 50% |
| 2395 | s34 | SNP | 40% |
| 2396 | s34 | REF | 45% |
| 2397 | s34 | REF | 45% |
| 2398 | s34 | SNP | 40% |
| 2399 | s34 | REF | 40% |
| 2400 | s34 | SNP | 35% |
| 2401 | s34 | SNP | 35% |
| 2402 | s34 | SNP | 45% |
| 2403 | s34 | REF | 50% |
| 2404 | s34 | SNP | 45% |
| 2405 | s34 | REF | 50% |
| 2406 | s34 | REF | 55% |
| 2407 | s34 | SNP | 50% |
| 2408 | s34 | SNP | 40% |
| 2409 | s34 | SNP | 40% |
| 2410 | s34 | SNP | 45% |
| 2411 | s34 | SNP | 45% |
| 2412 | s34 | REF | 50% |
| 2413 | s34 | REF | 55% |
| 2414 | s34 | REF | 50% |
| 2415 | s34 | REF | 50% |
| 2416 | s34 | SNP | 45% |
| 2417 | s34 | SNP | 50% |
| 2418 | s34 | SNP | 35% |
| 2419 | s34 | SNP | 35% |
| 2420 | s34 | REF | 40% |
| 2421 | s34 | SNP | 35% |
| 2422 | s34 | SNP | 45% |
| 2423 | s34 | REF | 50% |
| 2424 | s34 | REF | 50% |
| 2425 | s34 | SNP | 45% |
| 2426 | s34 | REF | 45% |
| 2427 | s34 | SNP | 40% |
| 2428 | s34 | REF | 50% |
| 2429 | s34 | SNP | 45% |
| 2430 | s34 | SNP | 45% |
| 2431 | s34 | SNP | 35% |
| 2432 | s35 | SNP | 70% |
| 2433 | s35 | REF | 80% |
| 2434 | s35 | SNP | 75% |
| 2435 | s35 | REF | 70% |
| 2436 | s35 | SNP | 65% |
| 2437 | s35 | SNP | 75% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 2438 | s35 | REF | 80% |
| 2439 | s35 | REF | 90% |
| 2440 | s35 | SNP | 75% |
| 2441 | s35 | REF | 80% |
| 2442 | s35 | SNP | 80% |
| 2443 | s35 | REF | 85% |
| 2444 | s35 | SNP | 80% |
| 2445 | s35 | REF | 85% |
| 2446 | s35 | SNP | 70% |
| 2447 | s35 | REF | 75% |
| 2448 | s35 | REF | 85% |
| 2449 | s35 | SNP | 80% |
| 2450 | s35 | SNP | 70% |
| 2451 | s35 | REF | 75% |
| 2452 | s35 | REF | 85% |
| 2453 | s35 | REF | 75% |
| 2454 | s35 | SNP | 70% |
| 2455 | s35 | SNP | 80% |
| 2456 | s35 | REF | 75% |
| 2457 | s35 | SNP | 70% |
| 2458 | s35 | SNP | 70% |
| 2459 | s35 | REF | 75% |
| 2460 | s35 | REF | 75% |
| 2461 | s35 | SNP | 70% |
| 2462 | s35 | REF | 75% |
| 2463 | s35 | SNP | 70% |
| 2464 | s35 | REF | 75% |
| 2465 | s35 | SNP | 70% |
| 2466 | s35 | REF | 75% |
| 2467 | s35 | SNP | 70% |
| 2468 | s35 | REF | 75% |
| 2469 | s35 | SNP | 65% |
| 2470 | s35 | SNP | 85% |
| 2471 | s35 | REF | 85% |
| 2472 | s35 | REF | 70% |
| 2473 | s35 | SNP | 80% |
| 2474 | s36 | SNP | 60% |
| 2475 | s36 | SNP | 65% |
| 2476 | s36 | SNP | 70% |
| 2477 | s36 | SNP | 60% |
| 2478 | s36 | SNP | 65% |
| 2479 | s36 | SNP | 70% |
| 2480 | s36 | SNP | 70% |
| 2481 | s36 | SNP | 65% |
| 2482 | s36 | REF | 70% |
| 2483 | s36 | SNP | 65% |
| 2484 | s36 | REF | 70% |
| 2485 | s36 | SNP | 60% |
| 2486 | s36 | SNP | 60% |
| 2487 | s36 | SNP | 60% |
| 2488 | s36 | REF | 65% |
| 2489 | s36 | SNP | 60% |
| 2490 | s36 | SNP | 70% |
| 2491 | s36 | SNP | 65% |
| 2492 | s36 | REF | 70% |
| 2493 | s36 | SNP | 65% |
| 2494 | s36 | SNP | 70% |
| 2495 | s36 | REF | 65% |
| 2496 | s36 | REF | 70% |
| 2497 | s36 | REF | 70% |
| 2498 | s36 | SNP | 65% |
| 2499 | s36 | SNP | 60% |
| 2500 | s36 | SNP | 60% |
| 2501 | s36 | REF | 65% |
| 2502 | s36 | SNP | 55% |
| 2503 | s36 | SNP | 60% |
| 2504 | s36 | SNP | 65% |
| 2505 | s36 | REF | 70% |
| 2506 | s36 | SNP | 60% |
| 2507 | s36 | SNP | 55% |
| 2508 | s7 | SNP | 40% |
| 2509 | s7 | SNP | 45% |
| 2510 | s7 | SNP | 50% |
| 2511 | s7 | SNP | 45% |
| 2512 | s7 | SNP | 35% |
| 2513 | s7 | SNP | 50% |
| 2514 | s7 | SNP | 40% |
| 2515 | s29 | SNP | 65% |
| 2516 | s29 | SNP | 65% |
| 2517 | s29 | SNP | 65% |
| 2518 | s29 | SNP | 65% |
| 2519 | s29 | SNP | 65% |
| 2520 | s29 | SNP | 75% |
| 2521 | s29 | SNP | 70% |
| 2522 | s29 | SNP | 65% |
| 2523 | s29 | SNP | 65% |
| 2524 | s29 | SNP | 75% |
| 2525 | s29 | SNP | 75% |
| 2526 | s29 | SNP | 75% |
| 2527 | s29 | SNP | 65% |
| 2528 | s29 | SNP | 75% |
| 2529 | s29 | REF | 65% |
| 2530 | s29 | SNP | 75% |
| 2531 | s29 | SNP | 75% |
| 2532 | s40 | SNP | 35% |
| 2533 | s40 | SNP | 35% |
| 2534 | s40 | SNP | 35% |
| 2535 | s40 | REF | 35% |
| 2536 | s40 | REF | 35% |
| 2537 | s40 | SNP | 35% |
| 2538 | s40 | SNP | 40% |
| 2539 | s40 | REF | 40% |
| 2540 | s40 | REF | 35% |
| 2541 | s40 | REF | 35% |
| 2542 | s40 | SNP | 35% |
| 2543 | s40 | SNP | 40% |
| 2544 | s40 | REF | 40% |
| 2545 | s40 | SNP | 40% |
| 2546 | s40 | SNP | 50% |
| 2547 | s40 | SNP | 45% |
| 2548 | s40 | REF | 45% |
| 2549 | s41 | SNP | 65% |
| 2550 | s41 | REF | 70% |
| 2551 | s41 | REF | 60% |
| 2552 | s41 | SNP | 55% |
| 2553 | s41 | REF | 80% |
| 2554 | s41 | SNP | 75% |
| 2555 | s41 | SNP | 70% |
| 2556 | s41 | REF | 75% |
| 2557 | s41 | SNP | 75% |
| 2558 | s41 | REF | 65% |
| 2559 | s41 | SNP | 60% |
| 2560 | s41 | REF | 80% |
| 2561 | s41 | SNP | 75% |
| 2562 | s41 | REF | 70% |
| 2563 | s41 | SNP | 65% |
| 2564 | s41 | REF | 70% |
| 2565 | s41 | SNP | 65% |
| 2566 | s41 | REF | 70% |
| 2567 | s41 | SNP | 65% |
| 2568 | s41 | REF | 70% |
| 2569 | s41 | SNP | 65% |
| 2570 | s41 | REF | 65% |
| 2571 | s41 | SNP | 60% |
| 2572 | s41 | REF | 65% |
| 2573 | s41 | REF | 80% |
| 2574 | s41 | SNP | 75% |
| 2575 | s41 | REF | 80% |
| 2576 | s41 | REF | 80% |
| 2577 | s41 | SNP | 75% |
| 2578 | s41 | SNP | 60% |
| 2579 | s41 | SNP | 75% |
| 2580 | s41 | REF | 80% |
| 2581 | s41 | SNP | 75% |
| 2582 | s41 | REF | 80% |
| 2583 | s41 | REF | 80% |
| 2584 | s41 | SNP | 75% |
| 2585 | s41 | REF | 80% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 2586 | s41 | SNP | 75% |
| 2587 | s41 | SNP | 75% |
| 2588 | s41 | SNP | 60% |
| 2589 | s41 | REF | 65% |
| 2590 | s41 | REF | 80% |
| 2591 | s41 | REF | 80% |
| 2592 | s41 | SNP | 75% |
| 2593 | s41 | SNP | 65% |
| 2594 | s41 | REF | 70% |
| 2595 | s41 | SNP | 65% |
| 2596 | s41 | REF | 70% |
| 2597 | s41 | REF | 70% |
| 2598 | s41 | SNP | 65% |
| 2599 | s41 | SNP | 75% |
| 2600 | s41 | REF | 80% |
| 2601 | s41 | SNP | 60% |
| 2602 | s41 | REF | 65% |
| 2603 | s41 | REF | 80% |
| 2604 | s41 | SNP | 75% |
| 2605 | s41 | SNP | 75% |
| 2606 | s41 | REF | 80% |
| 2607 | s42 | REF | 75% |
| 2608 | s42 | REF | 85% |
| 2609 | s42 | REF | 60% |
| 2610 | s42 | SNP | 55% |
| 2611 | s42 | SNP | 55% |
| 2612 | s42 | SNP | 60% |
| 2613 | s42 | REF | 80% |
| 2614 | s42 | SNP | 75% |
| 2615 | s42 | REF | 75% |
| 2616 | s42 | SNP | 70% |
| 2617 | s42 | REF | 60% |
| 2618 | s42 | SNP | 55% |
| 2619 | s42 | REF | 55% |
| 2620 | s42 | REF | 85% |
| 2621 | s42 | REF | 85% |
| 2622 | s42 | SNP | 80% |
| 2623 | s42 | REF | 80% |
| 2624 | s42 | REF | 60% |
| 2625 | s42 | SNP | 80% |
| 2626 | s42 | REF | 85% |
| 2627 | s42 | REF | 65% |
| 2628 | s42 | SNP | 60% |
| 2629 | s42 | SNP | 80% |
| 2630 | s42 | SNP | 65% |
| 2631 | s42 | SNP | 80% |
| 2632 | s42 | REF | 85% |
| 2633 | s42 | REF | 60% |
| 2634 | s42 | SNP | 55% |
| 2635 | s42 | SNP | 55% |
| 2636 | s42 | REF | 60% |
| 2637 | s42 | SNP | 65% |
| 2638 | s42 | REF | 70% |
| 2639 | s42 | REF | 60% |
| 2640 | s42 | REF | 65% |
| 2641 | s42 | SNP | 70% |
| 2642 | s42 | REF | 60% |
| 2643 | s42 | SNP | 60% |
| 2644 | s42 | REF | 65% |
| 2645 | s42 | SNP | 75% |
| 2646 | s42 | REF | 80% |
| 2647 | s42 | SNP | 60% |
| 2648 | s42 | REF | 65% |
| 2649 | s42 | SNP | 80% |
| 2650 | s42 | SNP | 65% |
| 2651 | s42 | REF | 70% |
| 2652 | s42 | SNP | 65% |
| 2653 | s42 | REF | 85% |
| 2654 | s42 | REF | 65% |
| 2655 | s42 | SNP | 60% |
| 2656 | s42 | REF | 65% |
| 2657 | s42 | SNP | 60% |
| 2658 | s42 | REF | 85% |
| 2659 | s42 | SNP | 80% |
| 2660 | s42 | SNP | 75% |
| 2661 | s42 | SNP | 60% |
| 2662 | s42 | SNP | 60% |
| 2663 | s42 | REF | 65% |
| 2664 | s75 | SNP | 45% |
| 2665 | s75 | SNP | 35% |
| 2666 | s75 | SNP | 45% |
| 2667 | s75 | SNP | 35% |
| 2668 | s75 | REF | 40% |
| 2669 | s75 | REF | 35% |
| 2670 | s75 | SNP | 40% |
| 2671 | s75 | SNP | 45% |
| 2672 | s75 | SNP | 35% |
| 2673 | s75 | SNP | 45% |
| 2674 | s75 | SNP | 45% |
| 2675 | s75 | SNP | 35% |
| 2676 | s75 | SNP | 45% |
| 2677 | s43 | SNP | 50% |
| 2678 | s43 | SNP | 65% |
| 2679 | s43 | REF | 60% |
| 2680 | s43 | REF | 65% |
| 2681 | s43 | SNP | 70% |
| 2682 | s43 | SNP | 75% |
| 2683 | s43 | REF | 70% |
| 2684 | s43 | SNP | 75% |
| 2685 | s43 | REF | 55% |
| 2686 | s43 | SNP | 70% |
| 2687 | s43 | REF | 65% |
| 2688 | s43 | SNP | 75% |
| 2689 | s43 | REF | 70% |
| 2690 | s43 | REF | 70% |
| 2691 | s43 | SNP | 70% |
| 2692 | s43 | SNP | 75% |
| 2693 | s43 | SNP | 75% |
| 2694 | s43 | REF | 70% |
| 2695 | s43 | SNP | 65% |
| 2696 | s43 | REF | 60% |
| 2697 | s43 | SNP | 65% |
| 2698 | s43 | REF | 70% |
| 2699 | s43 | SNP | 65% |
| 2700 | s43 | REF | 60% |
| 2701 | s43 | SNP | 65% |
| 2702 | s43 | REF | 70% |
| 2703 | s43 | SNP | 75% |
| 2704 | s43 | SNP | 65% |
| 2705 | s43 | SNP | 75% |
| 2706 | s43 | REF | 70% |
| 2707 | s43 | SNP | 70% |
| 2708 | s43 | REF | 70% |
| 2709 | s43 | SNP | 75% |
| 2710 | s43 | SNP | 65% |
| 2711 | s43 | REF | 60% |
| 2712 | s43 | REF | 60% |
| 2713 | s43 | REF | 70% |
| 2714 | s43 | SNP | 75% |
| 2715 | s43 | SNP | 60% |
| 2716 | s43 | REF | 60% |
| 2717 | s43 | SNP | 80% |
| 2718 | s43 | SNP | 65% |
| 2719 | s43 | SNP | 65% |
| 2720 | s43 | SNP | 65% |
| 2721 | s43 | SNP | 80% |
| 2722 | s43 | REF | 75% |
| 2723 | s43 | REF | 65% |
| 2724 | s43 | SNP | 60% |
| 2725 | s43 | REF | 55% |
| 2726 | s43 | SNP | 75% |
| 2727 | s43 | REF | 70% |
| 2728 | s43 | SNP | 65% |
| 2729 | s43 | REF | 60% |
| 2730 | s43 | REF | 70% |
| 2731 | s43 | SNP | 75% |
| 2732 | s43 | SNP | 65% |
| 2733 | s43 | SNP | 75% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 2734 | s43 | REF | 70% |
| 2735 | s43 | REF | 70% |
| 2736 | s43 | SNP | 75% |
| 2737 | s44 | SNP | 35% |
| 2738 | s44 | SNP | 35% |
| 2739 | s44 | REF | 35% |
| 2740 | s44 | SNP | 40% |
| 2741 | s44 | REF | 35% |
| 2742 | s44 | SNP | 45% |
| 2743 | s44 | REF | 40% |
| 2744 | s44 | SNP | 45% |
| 2745 | s44 | REF | 35% |
| 2746 | s44 | REF | 45% |
| 2747 | s44 | SNP | 45% |
| 2748 | s44 | REF | 45% |
| 2749 | s44 | REF | 35% |
| 2750 | s44 | REF | 40% |
| 2751 | s44 | REF | 40% |
| 2752 | s44 | REF | 60% |
| 2753 | s44 | REF | 35% |
| 2754 | s44 | REF | 40% |
| 2755 | s44 | REF | 45% |
| 2756 | s44 | SNP | 45% |
| 2757 | s44 | REF | 45% |
| 2758 | s44 | SNP | 50% |
| 2759 | s2 | SNP | 40% |
| 2760 | s2 | SNP | 45% |
| 2761 | s2 | SNP | 50% |
| 2762 | s2 | SNP | 50% |
| 2763 | s2 | SNP | 55% |
| 2764 | s2 | SNP | 40% |
| 2765 | s2 | SNP | 35% |
| 2766 | s2 | REF | 65% |
| 2767 | s2 | SNP | 45% |
| 2768 | s2 | SNP | 55% |
| 2769 | s2 | SNP | 55% |
| 2770 | s2 | SNP | 60% |
| 2771 | s2 | REF | 65% |
| 2772 | s2 | SNP | 60% |
| 2773 | s2 | REF | 60% |
| 2774 | s2 | SNP | 60% |
| 2775 | s45 | SNP | 40% |
| 2776 | s45 | REF | 45% |
| 2777 | s45 | REF | 45% |
| 2778 | s45 | SNP | 40% |
| 2779 | s45 | REF | 45% |
| 2780 | s45 | SNP | 40% |
| 2781 | s45 | SNP | 40% |
| 2782 | s45 | REF | 45% |
| 2783 | s45 | REF | 55% |
| 2784 | s45 | SNP | 45% |
| 2785 | s45 | REF | 50% |
| 2786 | s45 | REF | 45% |
| 2787 | s45 | REF | 45% |
| 2788 | s45 | REF | 50% |
| 2789 | s45 | SNP | 45% |
| 2790 | s45 | REF | 50% |
| 2791 | s45 | SNP | 45% |
| 2792 | s45 | REF | 50% |
| 2793 | s45 | SNP | 45% |
| 2794 | s45 | REF | 55% |
| 2795 | s45 | SNP | 50% |
| 2796 | s45 | REF | 50% |
| 2797 | s45 | SNP | 45% |
| 2798 | s45 | SNP | 40% |
| 2799 | s45 | REF | 45% |
| 2800 | s45 | SNP | 45% |
| 2801 | s45 | REF | 50% |
| 2802 | s45 | REF | 45% |
| 2803 | s45 | SNP | 40% |
| 2804 | s45 | SNP | 45% |
| 2805 | s45 | REF | 50% |
| 2806 | s45 | REF | 50% |
| 2807 | s45 | REF | 50% |
| 2808 | s45 | SNP | 45% |
| 2809 | s45 | REF | 50% |
| 2810 | s45 | SNP | 45% |
| 2811 | s45 | REF | 50% |
| 2812 | s45 | SNP | 50% |
| 2813 | s45 | REF | 55% |
| 2814 | s45 | REF | 55% |
| 2815 | s45 | SNP | 50% |
| 2816 | s45 | SNP | 45% |
| 2817 | s45 | SNP | 45% |
| 2818 | s45 | SNP | 45% |
| 2819 | s45 | REF | 50% |
| 2820 | s45 | REF | 50% |
| 2821 | s45 | SNP | 40% |
| 2822 | s45 | SNP | 45% |
| 2823 | s45 | SNP | 45% |
| 2824 | s45 | REF | 50% |
| 2825 | s45 | REF | 50% |
| 2826 | s45 | SNP | 45% |
| 2827 | s45 | REF | 55% |
| 2828 | s45 | SNP | 50% |
| 2829 | s45 | SNP | 45% |
| 2830 | s45 | REF | 50% |
| 2831 | s45 | REF | 50% |
| 2832 | s45 | SNP | 45% |
| 2833 | s45 | REF | 50% |
| 2834 | s45 | REF | 50% |
| 2835 | s45 | SNP | 45% |
| 2836 | s45 | SNP | 40% |
| 2837 | s45 | REF | 45% |
| 2838 | s45 | REF | 45% |
| 2839 | s45 | SNP | 40% |
| 2840 | s45 | REF | 50% |
| 2841 | s45 | SNP | 45% |
| 2842 | s45 | REF | 45% |
| 2843 | s45 | SNP | 40% |
| 2844 | s76 | SNP | 70% |
| 2845 | s76 | SNP | 50% |
| 2846 | s76 | SNP | 75% |
| 2847 | s76 | SNP | 60% |
| 2848 | s76 | SNP | 55% |
| 2849 | s76 | SNP | 70% |
| 2850 | s76 | SNP | 55% |
| 2851 | s76 | SNP | 50% |
| 2852 | s46 | SNP | 55% |
| 2853 | s46 | REF | 60% |
| 2854 | s46 | SNP | 60% |
| 2855 | s46 | REF | 65% |
| 2856 | s46 | SNP | 60% |
| 2857 | s46 | REF | 65% |
| 2858 | s46 | SNP | 65% |
| 2859 | s46 | REF | 70% |
| 2860 | s46 | SNP | 65% |
| 2861 | s46 | SNP | 60% |
| 2862 | s46 | REF | 65% |
| 2863 | s46 | SNP | 65% |
| 2864 | s46 | REF | 70% |
| 2865 | s46 | SNP | 65% |
| 2866 | s46 | SNP | 60% |
| 2867 | s46 | REF | 65% |
| 2868 | s46 | REF | 65% |
| 2869 | s46 | REF | 75% |
| 2870 | s46 | REF | 60% |
| 2871 | s46 | REF | 70% |
| 2872 | s46 | REF | 70% |
| 2873 | s46 | SNP | 65% |
| 2874 | s46 | REF | 65% |
| 2875 | s46 | REF | 70% |
| 2876 | s46 | SNP | 60% |
| 2877 | s46 | SNP | 60% |
| 2878 | s46 | SNP | 70% |
| 2879 | s46 | REF | 75% |
| 2880 | s46 | REF | 75% |
| 2881 | s46 | SNP | 70% |

TABLE 2-continued

Guide sequences designed to associate with specific SNPs of the GUCY2D gene

| SEQ ID NO: | SNP ID (Table 1) | Target (SNP/REF) | % GC |
|---|---|---|---|
| 2882 | s46 | REF | 65% |
| 2883 | s46 | SNP | 60% |
| 2884 | s46 | REF | 70% |
| 2885 | s46 | REF | 70% |
| 2886 | s46 | SNP | 70% |
| 2887 | s46 | REF | 75% |
| 2888 | s46 | REF | 75% |
| 2889 | s46 | SNP | 70% |
| 2890 | s46 | SNP | 70% |
| 2891 | s46 | REF | 75% |
| 2892 | s46 | REF | 75% |
| 2893 | s46 | SNP | 70% |
| 2894 | s46 | REF | 70% |
| 2895 | s46 | SNP | 65% |
| 2896 | s46 | REF | 65% |
| 2897 | s46 | REF | 65% |
| 2898 | s46 | SNP | 60% |
| 2899 | s46 | SNP | 60% |
| 2900 | s46 | SNP | 55% |
| 2901 | s46 | SNP | 65% |
| 2902 | s46 | REF | 70% |
| 2903 | s46 | SNP | 60% |
| 2904 | s46 | REF | 65% |
| 2905 | s46 | SNP | 60% |
| 2906 | s46 | REF | 65% |
| 2907 | s47 | REF | 75% |
| 2908 | s47 | SNP | 70% |
| 2909 | s47 | REF | 70% |
| 2910 | s47 | SNP | 65% |
| 2911 | s47 | SNP | 70% |
| 2912 | s47 | REF | 75% |
| 2913 | s47 | REF | 80% |
| 2914 | s47 | SNP | 75% |
| 2915 | s47 | SNP | 75% |
| 2916 | s47 | SNP | 75% |
| 2917 | s47 | REF | 75% |
| 2918 | s47 | SNP | 70% |
| 2919 | s47 | SNP | 70% |
| 2920 | s47 | REF | 75% |
| 2921 | s47 | SNP | 75% |
| 2922 | s47 | REF | 80% |
| 2923 | s47 | REF | 70% |
| 2924 | s47 | SNP | 65% |
| 2925 | s47 | SNP | 50% |
| 2926 | s47 | REF | 80% |
| 2927 | s47 | SNP | 75% |
| 2928 | s47 | REF | 75% |
| 2929 | s47 | REF | 55% |
| 2930 | s47 | SNP | 50% |
| 2931 | s47 | REF | 80% |
| 2932 | s47 | SNP | 75% |
| 2933 | s47 | SNP | 75% |
| 2934 | s47 | REF | 80% |
| 2935 | s47 | REF | 80% |
| 2936 | s47 | SNP | 75% |
| 2937 | s47 | SNP | 75% |
| 2938 | s47 | REF | 80% |
| 2939 | s47 | SNP | 60% |
| 2940 | s47 | REF | 80% |
| 2941 | s47 | REF | 65% |
| 2942 | s47 | SNP | 75% |
| 2943 | s47 | SNP | 75% |
| 2944 | s47 | REF | 80% |
| 2945 | s47 | SNP | 65% |
| 2946 | s47 | REF | 70% |
| 2947 | s47 | SNP | 75% |
| 2948 | s47 | REF | 80% |
| 2949 | s47 | SNP | 80% |
| 2950 | s47 | REF | 85% |
| 2951 | s47 | SNP | 60% |
| 2952 | s47 | REF | 85% |
| 2953 | s47 | SNP | 80% |
| 2954 | s47 | SNP | 75% |
| 2955 | s47 | REF | 80% |
| 2956 | s47 | REF | 65% |
| 2957 | s47 | SNP | 60% |
| 2958 | s47 | SNP | 75% |
| 2959 | s47 | REF | 80% |
| 2960 | s47 | REF | 80% |
| 2961 | s47 | SNP | 70% |
| 2962 | s47 | SNP | 75% |
| 2963 | s47 | REF | 55% |
| 2964 | s47 | SNP | 50% |
| 2965 | s48 | SNP | 65% |
| 2966 | s48 | REF | 70% |
| 2967 | s48 | SNP | 65% |
| 2968 | s48 | REF | 70% |
| 2969 | s48 | SNP | 65% |
| 2970 | s48 | SNP | 60% |
| 2971 | s48 | SNP | 65% |
| 2972 | s48 | REF | 70% |
| 2973 | s48 | SNP | 55% |
| 2974 | s48 | SNP | 55% |
| 2975 | s48 | SNP | 60% |
| 2976 | s48 | SNP | 55% |
| 2977 | s48 | SNP | 65% |
| 2978 | s48 | REF | 70% |
| 2979 | s48 | SNP | 65% |
| 2980 | s48 | SNP | 65% |
| 2981 | s48 | REF | 65% |
| 2982 | s48 | SNP | 55% |
| 2983 | s48 | SNP | 55% |
| 2984 | s48 | REF | 65% |
| 2985 | s48 | SNP | 60% |
| 2986 | s48 | SNP | 60% |
| 2987 | s48 | SNP | 60% |
| 2988 | s48 | REF | 65% |
| 2989 | s48 | SNP | 60% |
| 2990 | s48 | SNP | 55% |
| 2991 | s48 | REF | 60% |
| 2992 | s49 | SNP | 55% |
| 2993 | s49 | REF | 50% |
| 2994 | s49 | SNP | 65% |
| 2995 | s49 | REF | 60% |
| 2996 | s49 | SNP | 65% |
| 2997 | s49 | REF | 60% |
| 2998 | s49 | SNP | 50% |
| 2999 | s49 | REF | 45% |
| 3000 | s49 | REF | 55% |
| 3001 | s49 | SNP | 60% |
| 3002 | s49 | REF | 55% |
| 3003 | s49 | REF | 45% |
| 3004 | s49 | SNP | 50% |
| 3005 | s49 | SNP | 55% |
| 3006 | s49 | REF | 50% |
| 3007 | s49 | SNP | 60% |
| 3008 | s49 | SNP | 60% |
| 3009 | s49 | REF | 55% |
| 3010 | s49 | REF | 55% |

Examples are provided below to facilitate a more complete understanding of the invention. The following examples illustrate the exemplary modes of making and practicing the invention. However, the scope of the invention is not limited to specific embodiments disclosed in these Examples, which are for purposes of illustration only.

Experimental Details

EXAMPLE 1

GUCY2D Correction Anaylsis

Guide sequences comprising 17-20 nucleotides in the sequences of 17-20 contiguous nucleotides set forth in SEQ ID NOs: 1-3010 are screened for high on target activity. On target activity is determined by DNA capillary electrophoresis analysis.

According to DNA capillary electrophoresis analysis, guide sequences comprising 17-20 nucleotides in the sequences of 17-20 contiguous nucleotides set forth in SEQ ID NOs: 1-3010 are found to be suitable for correction of the GUCY2D gene.

Discussion

The guide sequences of the present invention are determined to be suitable for targeting the GUCY2D gene.

REFERENCES

1. Ahmad and Allen (1992) "Antibody-mediated Specific Binging and Cytotoxicity of Lipsome-entrapped Doxorubicin to Lung Cancer Cells in Vitro", Cancer Research 52:4817-20
2. Anders (1992) "Human gene therapy", Science 256: 808-13
3. Basha et al. (2011) "Influence of Cationic Lipid Composition on Gene Silencing Properties of Lipid Nanoparticle Formulations of siRNA in Antigen-Presenting Cells", Mol. Ther. 19(12):2186-200
4. Behr (1994) "Gene transfer with synthetic cationic amphiphiles: Prospects for gene therapy", Bioconjuage Chem 5:382-89
5. Blaese (1995) "Vectors in cancer therapy: how will they deliver", Cancer Gene Ther. 2:291-97
6. Blaese et al. (1995) "T lympocyte-directed gene therapy for ADA-SCID: initial trial results after 4 years", Science 270(5235):475-80
7. Buchschacher and Panganiban (1992) "Human immunodeficiency virus vectors for inducible expression of foreign genes", J. Virol. 66:2731-39
8. Burstein et al. (2017) "New CRISPR-Cas systems from uncultivated microbes", Nature 542:237-41
9. Chung et al. (2006) "Agrobacterium is not alone: gene transfer to plants by viruses and other bacteria", Trends Plant Sci. 11(1):1-4
10. Coelho et al. (2013) "Safety and Efficacy of RNAi Therapy for Transthyretin Amyloidosis", N Engl J. Med 369:819-29
11. Crystal (1995) "Transfer of genes to humans: early lessons and obstacles to success", Science 270(5235): 404-10
12. Dillon (1993) "Regulation gene expression in gene therapy" Trends in Biotechnology
13. Dranoff et al. (1997) "A phase I study of vaccination with autologous, irradiated melanoma cells engineered to secrete human granulocyte macrophage colony stimulating factor", Hum. Gene Ther. 8(1):111-23
14. Dunbar et al. (1995) "Retrovirally marked CD34-enriched peripheral blood and bone marrow cells contribute to long-term engraftment after autologous transplantation", Blood 85:3048-57
15. Ellem et al. (1997) "A case report: immune responses and clinical course of the first human use of ganulocyte/macrophage-colony-stimulating-factor-tranduced autologous melanoma cells for immunotherapy", Cancer Immunol Immunother 44:10-20
16. Gao and Huang (1995) "Cationic liposome-mediated gene transfer" Gene Ther. 2(10):710-22
17. Haddada et al. (1995) "Gene Therapy Using Adenovirus Vectors", in: The Molecular Repertoire of Adenoviruses III: Biology and Pathogenesis, ed. Doerfler and Bohm, pp. 297-306
18. Han et al. (1995) "Ligand-directed retro-viral targeting of human breast cancer cells", Proc Natl Acad Sci U.S.A. 92(21):9747-51
19. Inaba et al. (1992) "Generation of large numbers of dendritic cells from mouse bone marrow cultures supplemented with granulocyte/macrophage colony-stimulating factor", J Exp Med. 176(6):1693-702
20. Jinek et al. (2012) "A programmable dual-RNA-guided DNA endonuclease in adaptive bacterial immunity," Science 337(6096):816-21
21. Johan et al. (1992) "GLVR1, a receptor for gibbon ape leukemia virus, is homologous to a phosphate permease of Neurospora crassa and is expressed at high levels in the brain and thymus", J Virol 66(3):1635-40
22. Judge et al. (2006) "Design of noninflammatory synthetic siRNA mediating potent gene silencing in vivo", Mol Ther. 13(3):494-505
23. Kohn et al. (1995) "Engraftment of gene-modified umbilical cord blood cells in neonates with adnosine deaminase deficiency", Nature Medicine 1:1017-23
24. Kremer and Perricaudet (1995) "Adenovirus and adeno-associated virus mediated gene transfer", Br. Med. Bull. 51(1):31-44
25. Macdiarmid et al. (2009) "Sequential treatment of drug-resistant tumors with targeted minicells containing siRNA or a cytotoxic drug", Nat Biotehcnol. 27(7): 643-51
26. Malech et al. (1997) "Prolonged production of NADPH oxidase-corrected granulocyes after gene therapy of chronic granulomatous disease", PNAS 94(22):12133-38
27. Miller et al. (1991) "Construction and properties of retrovirus packaging cells based on gibbon ape leukemia virus", J Virol. 65(5):2220-24
28. Miller (1992) "Human gene therapy comes of age", Nature 357:455-60
29. Mitani and Caskey (1993) "Delivering therapeutic genes — matching approach and application", Trends in Biotechnology 11(5):162-66
30. Nabel and Felgner (1993) "Direct gene transfer for immunotherapy and immunization", Trends in Biotechnology 11(5):211-15
31. Remy et al. (1994) "Gene Transfer with a Series of Lipphilic DNA-Binding Molecules", Bioconjugate Chem. 5(6):647-54
32. Sentmanat et al. (2018) "A Survey of Validation Strategies for CRISPR-Cas9 Editing", Scientific Reports 8:888, doi:10.1038/s41598-018-19441-8
33. Sommerfelt et al. (1990) "Localization of the receptor gene for type D simian retroviruses on human chromosome 19", J. Virol. 64(12):6214-20
34. Van Brunt (1988) "Molecular framing: transgenic animals as bioactors" Biotechnology 6:1149-54
35. Vigne et al. (1995) "Third-generation adenovectors for gene therapy", Restorative Neurology and Neuroscience 8(1,2): 35-36
36. Wilson et al. (1989) "Formation of infectious hybrid virion with gibbon ape leukemia virus and human T-cell leukemia virus retroviral envelope glycoproteins and the gag and pol proteins of Moloney murine leukemia virus", J. Virol. 63:2374-78
37. Yu et al. (1994) "Progress towards gene therapy for HIV infection", Gene Ther. 1(1):13-26
38. Zetsche et al. (2015) "Cpf1 is a single RNA-guided endonuclease of a class 2 CRIPSR-Cas system" Cell 163(3):759-71
39. Zuris et al. (2015) "Cationic lipid-mediated delivery of proteins enables efficient protein based genome editing in vitro and in vivo" Nat Biotechnol. 33(1):73-80

SEQUENCE LISTING (3011 sequences)

SEQ ID NO: 1 - RNA, 20 nt, Artificial Sequence
  synthesized
ugugcuucuccuuagggucu

SEQ ID NO: 2 - RNA, 20 nt, Artificial Sequence
  synthesized
uugugcuucuccuuaggguc

SEQ ID NO: 3 - RNA, 20 nt, Artificial Sequence
  synthesized
uuugugcuucuccuuagggu

SEQ ID NO: 4 - RNA, 20 nt, Artificial Sequence
  synthesized
cuggaggaauaaauaaggga

SEQ ID NO: 5 - RNA, 20 nt, Artificial Sequence
  synthesized
ucaaucuucuuucccagacc

SEQ ID NO: 6 - RNA, 20 nt, Artificial Sequence
  synthesized
uggaggaauaaauaagggac

SEQ ID NO: 7 - RNA, 20 nt, Artificial Sequence
  synthesized
aaucuuggugucucggaguc

SEQ ID NO: 8 - RNA, 20 nt, Artificial Sequence
  synthesized
cuuggugucucggagucugu

SEQ ID NO: 9 - RNA, 20 nt, Artificial Sequence
  synthesized
ucuuggugucucggagucug

SEQ ID NO: 10 - RNA, 20 nt, Artificial Sequence
  synthesized
uuuauccagaugucgccacu

SEQ ID NO: 11 - RNA, 20 nt, Artificial Sequence
  synthesized
aauacgucucggcaauguuc

SEQ ID NO: 12 - RNA, 20 nt, Artificial Sequence
  synthesized
acaauacgucucggcaaugu

SEQ ID NO: 13 - RNA, 20 nt, Artificial Sequence
  synthesized
gaggguucccagaggucagu

SEQ ID NO: 14 - RNA, 20 nt, Artificial Sequence
  synthesized
gcccugucaauuacuagcug

SEQ ID NO: 15 - RNA, 20 nt, Artificial Sequence
  synthesized
ucauguauauaacugacccu

SEQ ID NO: 16 - RNA, 20 nt, Artificial Sequence
  synthesized
aggacccccaccgugaacac

SEQ ID NO: 17 - RNA, 20 nt, Artificial Sequence
  synthesized
gacccccaccgugaacacgg

SEQ ID NO: 18 - RNA, 20 nt, Artificial Sequence
  synthesized
cuagggggcagcagucacca

SEQ ID NO: 19 - RNA, 20 nt, Artificial Sequence
  synthesized
uagggggcagcagucaccag

SEQ ID NO: 20 - RNA, 20 nt, Artificial Sequence
  synthesized
gugcaagguccagaagagcc

SEQ ID NO: 21 - RNA, 20 nt, Artificial Sequence
  synthesized
cgggacaccuggcuugggug

SEQ ID NO: 22 - RNA, 20 nt, Artificial Sequence
  synthesized
gggacaccuggcuugggugg

SEQ ID NO: 23 - RNA, 20 nt, Artificial Sequence
  synthesized
aaacuggcugcuucuccugu

SEQ ID NO: 24 - RNA, 20 nt, Artificial Sequence
  synthesized
cuggcugcuucuccuguggg

SEQ ID NO: 25 - RNA, 20 nt, Artificial Sequence
  synthesized
ugggcaaguucccugauuau

SEQ ID NO: 26 - RNA, 20 nt, Artificial Sequence
  synthesized
uagggguugcaauuucccau

SEQ ID NO: 27 - RNA, 20 nt, Artificial Sequence
  synthesized
uuggaagaaucuaggggcau

SEQ ID NO: 28 - RNA, 20 nt, Artificial Sequence
  synthesized
aagcggagaaucccugaccc

SEQ ID NO: 29 - RNA, 20 nt, Artificial Sequence
  synthesized
gcccugaguccagcagggga

SEQ ID NO: 30 - RNA, 20 nt, Artificial Sequence
  synthesized
cucgccacccagcagcaccg

SEQ ID NO: 31 - RNA, 20 nt, Artificial Sequence
  synthesized
uccucgccacccagcagcac

SEQ ID NO: 32 - RNA, 20 nt, Artificial Sequence
  synthesized
ucgccacccagcagcaccga

SEQ ID NO: 33 - RNA, 20 nt, Artificial Sequence
  synthesized
ccccgggcucugcggucccg

SEQ ID NO: 34 - RNA, 20 nt, Artificial Sequence
  synthesized
ccgggcucugcggucccgcg

SEQ ID NO: 35 - RNA, 20 nt, Artificial Sequence
  synthesized
ggggcagggacggagcccac

SEQ ID NO: 36 - RNA, 20 nt, Artificial Sequence
  synthesized
caagaggauuggaggugucc

SEQ ID NO: 37 - RNA, 20 nt, Artificial Sequence
  synthesized
guggaaaugcugaggggcag

SEQ ID NO: 38 - RNA, 20 nt, Artificial Sequence
  synthesized
uccggccuggucagagccuc

SEQ ID NO: 39 - RNA, 20 nt, Artificial Sequence
  synthesized
aucuauauuacccaucuguc

SEQ ID NO: 40 - RNA, 20 nt, Artificial Sequence
  synthesized
ucuauauuacccaucugucc

SEQ ID NO: 41 - RNA, 20 nt, Artificial Sequence
  synthesized
gaacacucacaggcuguuua

SEQ ID NO: 42 - RNA, 20 nt, Artificial Sequence
  synthesized
cucgggcccacggcccccgg

SEQ ID NO: 43 - RNA, 20 nt, Artificial Sequence
  synthesized
ggcucgggcccacggccccc

SEQ ID NO: 44 - RNA, 20 nt, Artificial Sequence
  synthesized
gggggaccggcccugugacc

SEQ ID NO: 45 - RNA, 20 nt, Artificial Sequence
  synthesized
cuaccggagccucccagagc

SEQ ID NO: 46 - RNA, 20 nt, Artificial Sequence
  synthesized
gcuaccggagccucccagag

SEQ ID NO: 47 - RNA, 20 nt, Artificial Sequence
  synthesized
gugcuaccggagccucccag

SEQ ID NO: 48 - RNA, 20 nt, Artificial Sequence
  synthesized
accggagccucccagagcgg

SEQ ID NO: 49 - RNA, 20 nt, Artificial Sequence
  synthesized
agccucccagagcggagggu

SEQ ID NO: 50 - RNA, 20 nt, Artificial Sequence
  synthesized
cccuccgcucugggaggcuc

SEQ ID NO: 51 - RNA, 20 nt, Artificial Sequence
  synthesized
ccggagccucccagagcgga

SEQ ID NO: 52 - RNA, 20 nt, Artificial Sequence
  synthesized
ccuccgcucugggaggcucc

SEQ ID NO: 53 - RNA, 20 nt, Artificial Sequence
  synthesized
cucuuacccuccgcucuggg

SEQ ID NO: 54 - RNA, 20 nt, Artificial Sequence
  synthesized
gccucccagagcggagggua

SEQ ID NO: 55 - RNA, 20 nt, Artificial Sequence
  synthesized
uacccuccgcucugggaggc

SEQ ID NO: 56 - RNA, 20 nt, Artificial Sequence
  synthesized
uaccggagccucccagagcg

SEQ ID NO: 57 - RNA, 20 nt, Artificial Sequence
  synthesized
uccgcucugggaggcuccgg

SEQ ID NO: 58 - RNA, 20 nt, Artificial Sequence
  synthesized
gacucuuacccuccgcucug

SEQ ID NO: 59 - RNA, 20 nt, Artificial Sequence
  synthesized
ggacucuuacccuccgcucu

SEQ ID NO: 60 - RNA, 20 nt, Artificial Sequence
  synthesized
gggacucuuacccuccgcuc

SEQ ID NO: 61 - RNA, 20 nt, Artificial Sequence
  synthesized
acucuaccuggcugggcucc

SEQ ID NO: 62 - RNA, 20 nt, Artificial Sequence
  synthesized
cagcuggagcccagccaggu

SEQ ID NO: 63 - RNA, 20 nt, Artificial Sequence
  synthesized
gcuggagcccagccagguag

SEQ ID NO: 64 - RNA, 20 nt, Artificial Sequence
  synthesized
acguggaugcgguaagcugu

SEQ ID NO: 65 - RNA, 20 nt, Artificial Sequence
  synthesized
gagcucacggcgucccccac

SEQ ID NO: 66 - RNA, 20 nt, Artificial Sequence
  synthesized
guggaugcgguaagcugugg

SEQ ID NO: 67 - RNA, 20 nt, Artificial Sequence
  synthesized
gagacggggcugcugggggc

SEQ ID NO: 68 - RNA, 20 nt, Artificial Sequence
  synthesized
gcaggcagcucagguacaag

SEQ ID NO: 69 - RNA, 20 nt, Artificial Sequence
  synthesized
ggagacggggcugcuggggg

SEQ ID NO: 70 - RNA, 20 nt, Artificial Sequence
  synthesized
ucggagacggggcugcuggg

SEQ ID NO: 71 - RNA, 20 nt, Artificial Sequence
  synthesized
agggcccagacccuaaggag

SEQ ID NO: 72 - RNA, 20 nt, Artificial Sequence
  synthesized
gggcccagacccuaaggaga

SEQ ID NO: 73 - RNA, 20 nt, Artificial Sequence
  synthesized
gagcagggcccagacccuaa

SEQ ID NO: 74 - RNA, 20 nt, Artificial Sequence
  synthesized
gcagggcccagacccuaagg

SEQ ID NO: 75 - RNA, 20 nt, Artificial Sequence
  synthesized
agguaaguaggaagugagcu

SEQ ID NO: 76 - RNA, 20 nt, Artificial Sequence
  synthesized
gaaccaagcuugggcccuuc

SEQ ID NO: 77 - RNA, 20 nt, Artificial Sequence
  synthesized
ucacacagggccucgugcuc

SEQ ID NO: 78 - RNA, 20 nt, Artificial Sequence
  synthesized
ugaaccaagcuugggcccuu

SEQ ID NO: 79 - RNA, 20 nt, Artificial Sequence
  synthesized
aagcuggagaaggcgcggcc

SEQ ID NO: 80 - RNA, 20 nt, Artificial Sequence
  synthesized
acuucucaagagaacuggcc

SEQ ID NO: 81 - RNA, 20 nt, Artificial Sequence
  synthesized
gaagcuggagaaggcgcggc

SEQ ID NO: 82 - RNA, 20 nt, Artificial Sequence
  synthesized
ggaagcuggagaaggcgcgg

SEQ ID NO: 83 - RNA, 20 nt, Artificial Sequence
  synthesized
ucacuucucaagagaacugg

SEQ ID NO: 84 - RNA, 20 nt, Artificial Sequence
  synthesized
accgggcugcgugaguguga

SEQ ID NO: 85 - RNA, 20 nt, Artificial Sequence
  synthesized
guggauaccaggccaugugc

SEQ ID NO: 86 - RNA, 20 nt, Artificial Sequence
  synthesized
gcugccgcagguggcagaug

SEQ ID NO: 87 - RNA, 20 nt, Artificial Sequence
  synthesized
uggcgggccacagcugcucc

SEQ ID NO: 88 - RNA, 20 nt, Artificial Sequence
  synthesized
ccgugguugcuggaccugca

SEQ ID NO: 89 - RNA, 20 nt, Artificial Sequence
  synthesized
cgugguugcuggaccugcaa

SEQ ID NO: 90 - RNA, 20 nt, Artificial Sequence
  synthesized
agguuuaugcacuggggaug

SEQ ID NO: 91 - RNA, 20 nt, Artificial Sequence
  synthesized
uuuaugcacuggggaugaga

SEQ ID NO: 92 - RNA, 20 nt, Artificial Sequence
  synthesized
aguucaccccaccuccucaa

SEQ ID NO: 93 - RNA, 20 nt, Artificial Sequence
  synthesized
guucaccccaccuccucaaa

SEQ ID NO: 94 - RNA, 20 nt, Artificial Sequence
  synthesized
uucaccccaccuccucaaag

SEQ ID NO: 95 - RNA, 20 nt, Artificial Sequence
  synthesized
gacaucauugaccagggaua

SEQ ID NO: 96 - RNA, 20 nt, Artificial Sequence
  synthesized
gagacaucauugaccaggga

SEQ ID NO: 97 - RNA, 20 nt, Artificial Sequence
  synthesized
aaugagcucacaggcagugc

SEQ ID NO: 98 - RNA, 20 nt, Artificial Sequence
  synthesized
agugugguuggugggccagg

SEQ ID NO: 99 - RNA, 20 nt, Artificial Sequence
  synthesized
cuaaugagcucacaggcagu

SEQ ID NO: 100 - RNA, 20 nt, Artificial Sequence
  synthesized
ugugguuggugggccagggu

SEQ ID NO: 101 - RNA, 20 nt, Artificial Sequence
  synthesized
ccgggguuuaggaaccagcc

SEQ ID NO: 102 - RNA, 20 nt, Artificial Sequence
  synthesized
gaucccuuucugacuuagag

SEQ ID NO: 103 - RNA, 20 nt, Artificial Sequence
  synthesized
cguucauucaugaugauggc

SEQ ID NO: 104 - RNA, 20 nt, Artificial Sequence
  synthesized
guucauucaugaugauggca

SEQ ID NO: 105 - RNA, 20 nt, Artificial Sequence
  synthesized
cagaauagcccuggacauuc

SEQ ID NO: 106 - RNA, 20 nt, Artificial Sequence
  synthesized
gguucacucaggaguagagg

SEQ ID NO: 107 - RNA, 20 nt, Artificial Sequence
  synthesized
guucacucaggaguagagga

SEQ ID NO: 108 - RNA, 20 nt, Artificial Sequence
  synthesized
agaaggccgucuugguugcu

SEQ ID NO: 109 - RNA, 20 nt, Artificial Sequence
  synthesized
gagaaggccgucuugguugc

SEQ ID NO: 110 - RNA, 20 nt, Artificial Sequence
  synthesized
gaucagcacauagcuauccg

SEQ ID NO: 111 - RNA, 20 nt, Artificial Sequence
  synthesized
ccaccuccccgucuuguccc

SEQ ID NO: 112 - RNA, 20 nt, Artificial Sequence
  synthesized
gcgugagugugacggggaca

SEQ ID NO: 113 - RNA, 20 nt, Artificial Sequence
  synthesized
acggggacaagacggggagg

SEQ ID NO: 114 - RNA, 20 nt, Artificial Sequence
  synthesized
agugugacggggacaagacg

SEQ ID NO: 115 - RNA, 20 nt, Artificial Sequence
  synthesized
ccgucuuguccccgucacac

SEQ ID NO: 116 - RNA, 20 nt, Artificial Sequence
  synthesized
cggggacaagacggggaggu

SEQ ID NO: 117 - RNA, 20 nt, Artificial Sequence
  synthesized
gagugugacggggacaagac

SEQ ID NO: 118 - RNA, 20 nt, Artificial Sequence
  synthesized
gugacggggacaagacgggg

SEQ ID NO: 119 - RNA, 20 nt, Artificial Sequence
  synthesized
gugugacggggacaagacgg

SEQ ID NO: 120 - RNA, 20 nt, Artificial Sequence
  synthesized
ucuuguccccgucacacuca

SEQ ID NO: 121 - RNA, 20 nt, Artificial Sequence
  synthesized
ugacggggacaagacgggga

SEQ ID NO: 122 - RNA, 20 nt, Artificial Sequence
  synthesized
ugagugugacggggacaaga

SEQ ID NO: 123 - RNA, 20 nt, Artificial Sequence
  synthesized
gugucccccucccaccuccc

SEQ ID NO: 124 - RNA, 20 nt, Artificial Sequence
  synthesized
cagucaccagagaacaaugu

SEQ ID NO: 125 - RNA, 20 nt, Artificial Sequence
  synthesized
aacaaugugaaagcagaagc

SEQ ID NO: 126 - RNA, 20 nt, Artificial Sequence
  synthesized
ccagagaacaaugugaaagc

SEQ ID NO: 127 - RNA, 20 nt, Artificial Sequence
  synthesized
cugcuuucacauuguucucu

SEQ ID NO: 128 - RNA, 20 nt, Artificial Sequence
  synthesized
ucugcuuucacauuguucuc

SEQ ID NO: 129 - RNA, 20 nt, Artificial Sequence
  synthesized
ggagugggcacggcuucugc

SEQ ID NO: 130 - RNA, 20 nt, Artificial Sequence
  synthesized
gaucugauccgggagcgcac

SEQ ID NO: 131 - RNA, 20 nt, Artificial Sequence
  synthesized
ggaucugauccgggagcgca

SEQ ID NO: 132 - RNA, 20 nt, Artificial Sequence
  synthesized
acaccgcgccugaccuuugc

SEQ ID NO: 133 - RNA, 20 nt, Artificial Sequence
  synthesized
agagcccccguacauaccuu

SEQ ID NO: 134 - RNA, 20 nt, Artificial Sequence
  synthesized
caaaugguggaugaaauggu

SEQ ID NO: 135 - RNA, 20 nt, Artificial Sequence
  synthesized
uacaaaugguggaugaaaug

SEQ ID NO: 136 - RNA, 20 nt, Artificial Sequence
  synthesized
gagguuaaaacuauaugcug

SEQ ID NO: 137 - RNA, 20 nt, Artificial Sequence
  synthesized
gguuaaaacuauaugcuggg

SEQ ID NO: 138 - RNA, 20 nt, Artificial Sequence
  synthesized
uuugcuucuccuuagggucu

SEQ ID NO: 139 - RNA, 20 nt, Artificial Sequence
  synthesized
aaauaagggacaggaggucu

SEQ ID NO: 140 - RNA, 20 nt, Artificial Sequence
  synthesized
aaauaagggacgggaggucu

SEQ ID NO: 141 - RNA, 20 nt, Artificial Sequence
  synthesized
aauaagggacaggaggucug

SEQ ID NO: 142 - RNA, 20 nt, Artificial Sequence
  synthesized
aauaagggacgggaggucug

SEQ ID NO: 143 - RNA, 20 nt, Artificial Sequence
  synthesized
acgggaggucugggaaagaa

SEQ ID NO: 144 - RNA, 20 nt, Artificial Sequence
  synthesized
aggaauaaauaagggacagg

SEQ ID NO: 145 - RNA, 20 nt, Artificial Sequence
  synthesized
aggaauaaauaagggacggg

SEQ ID NO: 146 - RNA, 20 nt, Artificial Sequence
  synthesized
agggacgggaggucugggaa

SEQ ID NO: 147 - RNA, 20 nt, Artificial Sequence
  synthesized
gacaggaggucugggaaaga

SEQ ID NO: 148 - RNA, 20 nt, Artificial Sequence
  synthesized
gacgggaggucugggaaaga

SEQ ID NO: 149 - RNA, 20 nt, Artificial Sequence
  synthesized
ggaggaauaaauaagggaca

SEQ ID NO: 150 - RNA, 20 nt, Artificial Sequence
  synthesized
uaaauaagggacaggagguc

SEQ ID NO: 151 - RNA, 20 nt, Artificial Sequence
  synthesized
uaaauaagggacgggagguc

SEQ ID NO: 152 - RNA, 20 nt, Artificial Sequence
  synthesized
ucccgucccuuauuuauucc

SEQ ID NO: 153 - RNA, 20 nt, Artificial Sequence
  synthesized
uccugucccuuauuuauucc

SEQ ID NO: 154 - RNA, 20 nt, Artificial Sequence
  synthesized
cagaugucgccacuccccac

SEQ ID NO: 155 - RNA, 20 nt, Artificial Sequence
  synthesized
cagaugucgccacucccuac

SEQ ID NO: 156 - RNA, 20 nt, Artificial Sequence
  synthesized
ccacagacuccgagacacca

SEQ ID NO: 157 - RNA, 20 nt, Artificial Sequence
  synthesized
cuacagacuccgagacacca

SEQ ID NO: 158 - RNA, 20 nt, Artificial Sequence
  synthesized
cuguagggaguggcgacauc

SEQ ID NO: 159 - RNA, 20 nt, Artificial Sequence
  synthesized
cuguggggaguggcgacauc

SEQ ID NO: 160 - RNA, 20 nt, Artificial Sequence
  synthesized
gccacuccccacagacuccg

SEQ ID NO: 161 - RNA, 20 nt, Artificial Sequence
  synthesized
gccacucccuacagacuccg

SEQ ID NO: 162 - RNA, 20 nt, Artificial Sequence
  synthesized
gucucggagucuguagggag

SEQ ID NO: 163 - RNA, 20 nt, Artificial Sequence
  synthesized
gucucggagucuguggggag

SEQ ID NO: 164 - RNA, 20 nt, Artificial Sequence
  synthesized
gugucucggagucuguaggg

SEQ ID NO: 165 - RNA, 20 nt, Artificial Sequence
  synthesized
gugucucggagucugugggg

SEQ ID NO: 166 - RNA, 20 nt, Artificial Sequence
  synthesized
uccccacagacuccgagaca

SEQ ID NO: 167 - RNA, 20 nt, Artificial Sequence
  synthesized
ucccuacagacuccgagaca

SEQ ID NO: 168 - RNA, 20 nt, Artificial Sequence
  synthesized
ucgccacuccccacagacuc

SEQ ID NO: 169 - RNA, 20 nt, Artificial Sequence
  synthesized
ucgccacucccuacagacuc

SEQ ID NO: 170 - RNA, 20 nt, Artificial Sequence
  synthesized
ucggagucuguagggagugg

SEQ ID NO: 171 - RNA, 20 nt, Artificial Sequence
  synthesized
ucggagucuguggggagugg

SEQ ID NO: 172 - RNA, 20 nt, Artificial Sequence
  synthesized
ucucggagucuguagggagu

SEQ ID NO: 173 - RNA, 20 nt, Artificial Sequence
  synthesized
ucucggagucuguggggagu

SEQ ID NO: 174 - RNA, 20 nt, Artificial Sequence
  synthesized
ucuguagggaguggcgacau

SEQ ID NO: 175 - RNA, 20 nt, Artificial Sequence
  synthesized
ucuguggggaguggcgacau

SEQ ID NO: 176 - RNA, 20 nt, Artificial Sequence
  synthesized
uggugucucggagucuguag

SEQ ID NO: 177 - RNA, 20 nt, Artificial Sequence
  synthesized
uggugucucggagucugugg

SEQ ID NO: 178 - RNA, 20 nt, Artificial Sequence
  synthesized
uguagggaguggcgacaucu

SEQ ID NO: 179 - RNA, 20 nt, Artificial Sequence
  synthesized
uguggggaguggcgacaucu

SEQ ID NO: 180 - RNA, 20 nt, Artificial Sequence
  synthesized
uuggugucucggagucugua

SEQ ID NO: 181 - RNA, 20 nt, Artificial Sequence
  synthesized
uuggugucucggagucugug

SEQ ID NO: 182 - RNA, 20 nt, Artificial Sequence
  synthesized
caguagcugggacuacaggc

SEQ ID NO: 183 - RNA, 20 nt, Artificial Sequence
  synthesized
cccacaguagcugggacuac

SEQ ID NO: 184 - RNA, 20 nt, Artificial Sequence
  synthesized
cugggacuacagacgcccgc

SEQ ID NO: 185 - RNA, 20 nt, Artificial Sequence
  synthesized
gucuguagucccagcuacug

SEQ ID NO: 186 - RNA, 20 nt, Artificial Sequence
  synthesized
aaauaaugccggaacauugc

SEQ ID NO: 187 - RNA, 20 nt, Artificial Sequence
  synthesized
aaauaaugcuggaacauugc

SEQ ID NO: 188 - RNA, 20 nt, Artificial Sequence
  synthesized
auaaugccggaacauugccg

SEQ ID NO: 189 - RNA, 20 nt, Artificial Sequence
  synthesized
auaaugcuggaacauugccg

SEQ ID NO: 190 - RNA, 20 nt, Artificial Sequence
  synthesized
ggcaauguuccagcauuauu

SEQ ID NO: 191 - RNA, 20 nt, Artificial Sequence
  synthesized
ggcaauguuccggcauuauu

SEQ ID NO: 192 - RNA, 20 nt, Artificial Sequence
  synthesized
uccggcauuauuucaaaucu

SEQ ID NO: 193 - RNA, 20 nt, Artificial Sequence
  synthesized
uguuccggcauuauuucaaa

SEQ ID NO: 194 - RNA, 20 nt, Artificial Sequence
  synthesized
aauuacuagcugagaucaac

SEQ ID NO: 195 - RNA, 20 nt, Artificial Sequence
  synthesized
agcugagaacaacugaccuc

SEQ ID NO: 196 - RNA, 20 nt, Artificial Sequence
  synthesized
agcugagaucaacugaccuc

SEQ ID NO: 197 - RNA, 20 nt, Artificial Sequence
  synthesized
aguugaucucagcuaguaau

SEQ ID NO: 198 - RNA, 20 nt, Artificial Sequence
  synthesized
aguuguucucagcuaguaau

SEQ ID NO: 199 - RNA, 20 nt, Artificial Sequence
  synthesized
aucucagcuaguaauugaca

SEQ ID NO: 200 - RNA, 20 nt, Artificial Sequence
  synthesized
ccagaggucaguugaucuca

SEQ ID NO: 201 - RNA, 20 nt, Artificial Sequence
  synthesized
ccagaggucaguuguucuca

SEQ ID NO: 202 - RNA, 20 nt, Artificial Sequence
  synthesized
cugagaucaacugaccucug

SEQ ID NO: 203 - RNA, 20 nt, Artificial Sequence
  synthesized
gaucucagcuaguaauugac

SEQ ID NO: 204 - RNA, 20 nt, Artificial Sequence
  synthesized
gcugagaacaacugaccucu

SEQ ID NO: 205 - RNA, 20 nt, Artificial Sequence
  synthesized
gcugagaucaacugaccucu

SEQ ID NO: 206 - RNA, 20 nt, Artificial Sequence
  synthesized
guucucagcuaguaauugac

SEQ ID NO: 207 - RNA, 20 nt, Artificial Sequence
  synthesized
ucaauuacuagcugagauca

SEQ ID NO: 208 - RNA, 20 nt, Artificial Sequence
  synthesized
ucaguugaucucagcuagua

SEQ ID NO: 209 - RNA, 20 nt, Artificial Sequence
  synthesized
ugaucucagcuaguaauuga

SEQ ID NO: 210 - RNA, 20 nt, Artificial Sequence
  synthesized
uguucucagcuaguaauuga

SEQ ID NO: 211 - RNA, 20 nt, Artificial Sequence
  synthesized
uucucagcuaguaauugaca

SEQ ID NO: 212 - RNA, 20 nt, Artificial Sequence
  synthesized
ucaaaaaaucuuggugucuc

SEQ ID NO: 213 - RNA, 20 nt, Artificial Sequence
  synthesized
ucagaaaaucuuggugucuc

SEQ ID NO: 214 - RNA, 20 nt, Artificial Sequence
  synthesized
uucagaaaaucuuggugucu

SEQ ID NO: 215 - RNA, 20 nt, Artificial Sequence
  synthesized
ccaguuccuucccaccuuca

SEQ ID NO: 216 - RNA, 20 nt, Artificial Sequence
  synthesized
ccgguuccuucccaccuuca

SEQ ID NO: 217 - RNA, 20 nt, Artificial Sequence
  synthesized
gagugaaggugggaaggaac

SEQ ID NO: 218 - RNA, 20 nt, Artificial Sequence
  synthesized
gcagggcugagccaguuccu

SEQ ID NO: 219 - RNA, 20 nt, Artificial Sequence
  synthesized
gcagggcugagccgguuccu

SEQ ID NO: 220 - RNA, 20 nt, Artificial Sequence
  synthesized
ugaaggugggaaggaaccgg

SEQ ID NO: 221 - RNA, 20 nt, Artificial Sequence
  synthesized
ugaaggugggaaggaacugg

SEQ ID NO: 222 - RNA, 20 nt, Artificial Sequence
  synthesized
uggagugggcagggcugagc

SEQ ID NO: 223 - RNA, 20 nt, Artificial Sequence
  synthesized
aacugacccucaagcagucc

SEQ ID NO: 224 - RNA, 20 nt, Artificial Sequence
  synthesized
aacugacccucgagcagucc

SEQ ID NO: 225 - RNA, 20 nt, Artificial Sequence
  synthesized
aucauguauauaacugaccc

SEQ ID NO: 226 - RNA, 20 nt, Artificial Sequence
  synthesized
auguauauaacugacccuca

SEQ ID NO: 227 - RNA, 20 nt, Artificial Sequence
  synthesized
auguauauaacugacccucg

SEQ ID NO: 228 - RNA, 20 nt, Artificial Sequence
  synthesized
ucgagggucaguuauauaca

SEQ ID NO: 229 - RNA, 20 nt, Artificial Sequence
  synthesized
ugacccucaagcaguccaga

SEQ ID NO: 230 - RNA, 20 nt, Artificial Sequence
  synthesized
ugacccucgagcaguccaga

SEQ ID NO: 231 - RNA, 20 nt, Artificial Sequence
  synthesized
aacacggaggagagggcggg

SEQ ID NO: 232 - RNA, 20 nt, Artificial Sequence
  synthesized
aacacggcggagagggcggg

SEQ ID NO: 233 - RNA, 20 nt, Artificial Sequence
  synthesized
acccccaccgugaacacgga

SEQ ID NO: 234 - RNA, 20 nt, Artificial Sequence
  synthesized
acccccaccgugaacacggc

SEQ ID NO: 235 - RNA, 20 nt, Artificial Sequence
  synthesized
accgugaacacggaggagag

SEQ ID NO: 236 - RNA, 20 nt, Artificial Sequence
  synthesized
accgugaacacggcggagag

SEQ ID NO: 237 - RNA, 20 nt, Artificial Sequence
  synthesized
caccgugaacacggaggaga

SEQ ID NO: 238 - RNA, 20 nt, Artificial Sequence
  synthesized
caccgugaacacggcggaga

SEQ ID NO: 239 - RNA, 20 nt, Artificial Sequence
  synthesized
cagccccccgcccucuccgc

SEQ ID NO: 240 - RNA, 20 nt, Artificial Sequence
  synthesized
cagccccccgcccucuccuc

SEQ ID NO: 241 - RNA, 20 nt, Artificial Sequence
  synthesized
ccaccgugaacacggaggag

SEQ ID NO: 242 - RNA, 20 nt, Artificial Sequence
  synthesized
ccaccgugaacacggcggag

SEQ ID NO: 243 - RNA, 20 nt, Artificial Sequence
  synthesized
ccccaccgugaacacggagg

SEQ ID NO: 244 - RNA, 20 nt, Artificial Sequence
  synthesized
ccccaccgugaacacggcgg

SEQ ID NO: 245 - RNA, 20 nt, Artificial Sequence
  synthesized
ccucuccgccguguucacgg

SEQ ID NO: 246 - RNA, 20 nt, Artificial Sequence
  synthesized
ccucuccuccguguucacgg

SEQ ID NO: 247 - RNA, 20 nt, Artificial Sequence
  synthesized
cgcccucuccgccguguuca

SEQ ID NO: 248 - RNA, 20 nt, Artificial Sequence
  synthesized
cgcccucuccuccguguuca

SEQ ID NO: 249 - RNA, 20 nt, Artificial Sequence
  synthesized
cgugaacacggaggagaggg

SEQ ID NO: 250 - RNA, 20 nt, Artificial Sequence
  synthesized
cgugaacacggcggagaggg

SEQ ID NO: 251 - RNA, 20 nt, Artificial Sequence
  synthesized
cuccgccguguucacggugg

SEQ ID NO: 252 - RNA, 20 nt, Artificial Sequence
  synthesized
cuccuccguguucacggugg

SEQ ID NO: 253 - RNA, 20 nt, Artificial Sequence
  synthesized
cucuccgccguguucacggu

SEQ ID NO: 254 - RNA, 20 nt, Artificial Sequence
  synthesized
cucuccuccguguucacggu

SEQ ID NO: 255 - RNA, 20 nt, Artificial Sequence
  synthesized
gaacacggaggagagggcgg

SEQ ID NO: 256 - RNA, 20 nt, Artificial Sequence
  synthesized
gaacacggcggagagggcgg

SEQ ID NO: 257 - RNA, 20 nt, Artificial Sequence
  synthesized
gcccucuccgccguguucac

SEQ ID NO: 258 - RNA, 20 nt, Artificial Sequence
  synthesized
gcccucuccuccguguucac

SEQ ID NO: 259 - RNA, 20 nt, Artificial Sequence
  synthesized
gugaacacggaggagagggc

SEQ ID NO: 260 - RNA, 20 nt, Artificial Sequence
  synthesized
gugaacacggcggagagggc

SEQ ID NO: 261 - RNA, 20 nt, Artificial Sequence
  synthesized
ucuccgccguguucacggug

SEQ ID NO: 262 - RNA, 20 nt, Artificial Sequence
  synthesized
ucuccuccguguucacggug

SEQ ID NO: 263 - RNA, 20 nt, Artificial Sequence
  synthesized
ugaacacggaggagagggcg

SEQ ID NO: 264 - RNA, 20 nt, Artificial Sequence
  synthesized
ugaacacggcggagagggcg

SEQ ID NO: 265 - RNA, 20 nt, Artificial Sequence
  synthesized
agggggcagcagucaccaga

SEQ ID NO: 266 - RNA, 20 nt, Artificial Sequence
  synthesized
cagcagucaccagagaacaa

SEQ ID NO: 267 - RNA, 20 nt, Artificial Sequence
  synthesized
cagucaccagaggacaaugu

SEQ ID NO: 268 - RNA, 20 nt, Artificial Sequence
  synthesized
ccagaggacaaugugaaagc

SEQ ID NO: 269 - RNA, 20 nt, Artificial Sequence
  synthesized
cugcuuucacauuguccucu

SEQ ID NO: 270 - RNA, 20 nt, Artificial Sequence
  synthesized
gacaaugugaaagcagaagc

SEQ ID NO: 271 - RNA, 20 nt, Artificial Sequence
  synthesized
gcagucaccagagaacaaug

SEQ ID NO: 272 - RNA, 20 nt, Artificial Sequence
  synthesized
gcagucaccagaggacaaug

SEQ ID NO: 273 - RNA, 20 nt, Artificial Sequence
  synthesized
ucugcuuucacauuguccuc

SEQ ID NO: 274 - RNA, 20 nt, Artificial Sequence
  synthesized
aagguccagaagagcccgag

SEQ ID NO: 275 - RNA, 20 nt, Artificial Sequence
  synthesized
aagguccagaagagcccggg

SEQ ID NO: 276 - RNA, 20 nt, Artificial Sequence
  synthesized
caagguccagaagagcccga

SEQ ID NO: 277 - RNA, 20 nt, Artificial Sequence
  synthesized
caagguccagaagagcccgg

SEQ ID NO: 278 - RNA, 20 nt, Artificial Sequence
  synthesized
cuguguuccccgggcucuuc

SEQ ID NO: 279 - RNA, 20 nt, Artificial Sequence
  synthesized
cuguguuccucgggcucuuc

SEQ ID NO: 280 - RNA, 20 nt, Artificial Sequence
  synthesized
gaagagcccgaggaacacag

SEQ ID NO: 281 - RNA, 20 nt, Artificial Sequence
  synthesized
gaagagcccggggaacacag

SEQ ID NO: 282 - RNA, 20 nt, Artificial Sequence
  synthesized
gcaagguccagaagagcccg

SEQ ID NO: 283 - RNA, 20 nt, Artificial Sequence
  synthesized
gcuguguuccccgggcucuu

SEQ ID NO: 284 - RNA, 20 nt, Artificial Sequence
  synthesized
gcuguguuccucgggcucuu

SEQ ID NO: 285 - RNA, 20 nt, Artificial Sequence
  synthesized
guccagaagagcccgaggaa

SEQ ID NO: 286 - RNA, 20 nt, Artificial Sequence
  synthesized
guccagaagagcccggggaa

SEQ ID NO: 287 - RNA, 20 nt, Artificial Sequence
  synthesized
uccccgggcucuucuggacc

SEQ ID NO: 288 - RNA, 20 nt, Artificial Sequence
  synthesized
ugcaagguccagaagagccc

SEQ ID NO: 289 - RNA, 20 nt, Artificial Sequence
  synthesized
uguguuccccgggcucuucu

SEQ ID NO: 290 - RNA, 20 nt, Artificial Sequence
  synthesized
uguguuccucgggcucuucu

SEQ ID NO: 291 - RNA, 20 nt, Artificial Sequence
  synthesized
accugucgaguguauccacc

SEQ ID NO: 292 - RNA, 20 nt, Artificial Sequence
  synthesized
accugucgaguguauccucc

SEQ ID NO: 293 - RNA, 20 nt, Artificial Sequence
  synthesized
aucaggaggauacacucgac

SEQ ID NO: 294 - RNA, 20 nt, Artificial Sequence
  synthesized
aucagguggauacacucgac

SEQ ID NO: 295 - RNA, 20 nt, Artificial Sequence
  synthesized
auccuccugaugaagcagug

SEQ ID NO: 296 - RNA, 20 nt, Artificial Sequence
  synthesized
ccaccugaugaagcagugcu

SEQ ID NO: 297 - RNA, 20 nt, Artificial Sequence
  synthesized
ccagcacugcuucaucagga

SEQ ID NO: 298 - RNA, 20 nt, Artificial Sequence
  synthesized
cccagcacugcuucaucagg

SEQ ID NO: 299 - RNA, 20 nt, Artificial Sequence
  synthesized
cuucaucaggaggauacacu

SEQ ID NO: 300 - RNA, 20 nt, Artificial Sequence
  synthesized
cuucaucagguggauacacu

SEQ ID NO: 301 - RNA, 20 nt, Artificial Sequence
  synthesized
gaggauacacucgacaggug

SEQ ID NO: 302 - RNA, 20 nt, Artificial Sequence
  synthesized
gcccagcacugcuucaucag

SEQ ID NO: 303 - RNA, 20 nt, Artificial Sequence
  synthesized
guggauacacucgacaggug

SEQ ID NO: 304 - RNA, 20 nt, Artificial Sequence
  synthesized
guguauccaccugaugaagc

SEQ ID NO: 305 - RNA, 20 nt, Artificial Sequence
  synthesized
ucaggaggauacacucgaca

SEQ ID NO: 306 - RNA, 20 nt, Artificial Sequence
  synthesized
ucagguggauacacucgaca

SEQ ID NO: 307 - RNA, 20 nt, Artificial Sequence
  synthesized
uccuccugaugaagcagugc

SEQ ID NO: 308 - RNA, 20 nt, Artificial Sequence
  synthesized
ugcccagcacugcuucauca

SEQ ID NO: 309 - RNA, 20 nt, Artificial Sequence
  synthesized
ugcuucaucaggaggauaca

SEQ ID NO: 310 - RNA, 20 nt, Artificial Sequence
  synthesized
ugcuucaucagguggauaca

SEQ ID NO: 311 - RNA, 20 nt, Artificial Sequence
  synthesized
ugucgaguguauccaccuga

SEQ ID NO: 312 - RNA, 20 nt, Artificial Sequence
  synthesized
ugucgaguguauccuccuga

SEQ ID NO: 313 - RNA, 20 nt, Artificial Sequence
  synthesized
acguucugcaggcagcagag

SEQ ID NO: 314 - RNA, 20 nt, Artificial Sequence
  synthesized
agaacgccccacccaagcca

SEQ ID NO: 315 - RNA, 20 nt, Artificial Sequence
  synthesized
agaacgucccacccaagcca

SEQ ID NO: 316 - RNA, 20 nt, Artificial Sequence
  synthesized
cagaacgccccacccaagcc

SEQ ID NO: 317 - RNA, 20 nt, Artificial Sequence
  synthesized
cagaacgucccacccaagcc

SEQ ID NO: 318 - RNA, 20 nt, Artificial Sequence
  synthesized
cugccugcagaacgccccac

SEQ ID NO: 319 - RNA, 20 nt, Artificial Sequence
  synthesized
cugccugcagaacgucccac

SEQ ID NO: 320 - RNA, 20 nt, Artificial Sequence
  synthesized
cuugggugggacguucugca

SEQ ID NO: 321 - RNA, 20 nt, Artificial Sequence
  synthesized
gacguucugcaggcagcaga

SEQ ID NO: 322 - RNA, 20 nt, Artificial Sequence
  synthesized
gccccacccaagccaggugu

SEQ ID NO: 323 - RNA, 20 nt, Artificial Sequence
  synthesized
gcguucugcaggcagcagag

SEQ ID NO: 324 - RNA, 20 nt, Artificial Sequence
  synthesized
gcuugggugggacguucugc

SEQ ID NO: 325 - RNA, 20 nt, Artificial Sequence
  synthesized
gcuuggguggggcguucugc

SEQ ID NO: 326 - RNA, 20 nt, Artificial Sequence
  synthesized
gggcguucugcaggcagcag

SEQ ID NO: 327 - RNA, 20 nt, Artificial Sequence
  synthesized
gucccacccaagccaggugu

SEQ ID NO: 328 - RNA, 20 nt, Artificial Sequence
  synthesized
ucgggacaccuggcuugggu

SEQ ID NO: 329 - RNA, 20 nt, Artificial Sequence
  synthesized
uggcuugggugggacguucu

SEQ ID NO: 330 - RNA, 20 nt, Artificial Sequence
  synthesized
uggcuuggguggggcguucu

SEQ ID NO: 331 - RNA, 20 nt, Artificial Sequence
  synthesized
ugggacguucugcaggcagc

SEQ ID NO: 332 - RNA, 20 nt, Artificial Sequence
  synthesized
uggggcguucugcaggcagc

SEQ ID NO: 333 - RNA, 20 nt, Artificial Sequence
  synthesized
aguucccugauuauacccac

SEQ ID NO: 334 - RNA, 20 nt, Artificial Sequence
  synthesized
aguucccugauuaugcccac

SEQ ID NO: 335 - RNA, 20 nt, Artificial Sequence
  synthesized
cugauuauacccacaggaga

SEQ ID NO: 336 - RNA, 20 nt, Artificial Sequence
  synthesized
cugauuaugcccacaggaga

SEQ ID NO: 337 - RNA, 20 nt, Artificial Sequence
  synthesized
cuucuccugugggcauaauc

SEQ ID NO: 338 - RNA, 20 nt, Artificial Sequence
  synthesized
cuucuccuguggguauaauc

SEQ ID NO: 339 - RNA, 20 nt, Artificial Sequence
  synthesized
guucccugauuauacccaca

SEQ ID NO: 340 - RNA, 20 nt, Artificial Sequence
  synthesized
guucccugauuaugcccaca

SEQ ID NO: 341 - RNA, 20 nt, Artificial Sequence
  synthesized
ucccugauuauacccacagg

SEQ ID NO: 342 - RNA, 20 nt, Artificial Sequence
  synthesized
ucccugauuaugcccacagg

SEQ ID NO: 343 - RNA, 20 nt, Artificial Sequence
  synthesized
ucuccugugggcauaaucag

SEQ ID NO: 344 - RNA, 20 nt, Artificial Sequence
  synthesized
ucuccuguggguauaaucag

SEQ ID NO: 345 - RNA, 20 nt, Artificial Sequence
  synthesized
uucuccugugggcauaauca

SEQ ID NO: 346 - RNA, 20 nt, Artificial Sequence
  synthesized
uucuccuguggguauaauca

SEQ ID NO: 347 - RNA, 20 nt, Artificial Sequence
  synthesized
aagaaucuaggggcaucgau

SEQ ID NO: 348 - RNA, 20 nt, Artificial Sequence
  synthesized
aagaaucuaggggcauugau

SEQ ID NO: 349 - RNA, 20 nt, Artificial Sequence
  synthesized
aaugccccuagauucuucca

SEQ ID NO: 350 - RNA, 20 nt, Artificial Sequence
  synthesized
aauuucccaucaaugccccu

SEQ ID NO: 351 - RNA, 20 nt, Artificial Sequence
  synthesized
aauuucccaucgaugccccu

SEQ ID NO: 352 - RNA, 20 nt, Artificial Sequence
  synthesized
agaaucuaggggcaucgaug

SEQ ID NO: 353 - RNA, 20 nt, Artificial Sequence
  synthesized
agaaucuaggggcauugaug

SEQ ID NO: 354 - RNA, 20 nt, Artificial Sequence
  synthesized
cgaugggaaauugcaacccc

SEQ ID NO: 355 - RNA, 20 nt, Artificial Sequence
  synthesized
gaagaaucuaggggcaucga

SEQ ID NO: 356 - RNA, 20 nt, Artificial Sequence
  synthesized
gaagaaucuaggggcauuga

SEQ ID NO: 357 - RNA, 20 nt, Artificial Sequence
  synthesized
gaugccccuagauucuucca

SEQ ID NO: 358 - RNA, 20 nt, Artificial Sequence
  synthesized
uaggggcaucgaugggaaau

SEQ ID NO: 359 - RNA, 20 nt, Artificial Sequence
  synthesized
ugaugggaaauugcaacccc

SEQ ID NO: 360 - RNA, 20 nt, Artificial Sequence
  synthesized
ugcaauuucccaucgaugcc

SEQ ID NO: 361 - RNA, 20 nt, Artificial Sequence
  synthesized
agcaggggauuugaggguca

SEQ ID NO: 362 - RNA, 20 nt, Artificial Sequence
  synthesized
caaauccccugcuggacuca

SEQ ID NO: 363 - RNA, 20 nt, Artificial Sequence
  synthesized
cacauccccugcuggacuca

SEQ ID NO: 364 - RNA, 20 nt, Artificial Sequence
  synthesized
cagcaggggauuugaggguc

SEQ ID NO: 365 - RNA, 20 nt, Artificial Sequence
  synthesized
ccagcaggggaugugagggu

SEQ ID NO: 366 - RNA, 20 nt, Artificial Sequence
  synthesized
ccagcaggggauuugagggu

SEQ ID NO: 367 - RNA, 20 nt, Artificial Sequence
  synthesized
ccugaguccagcaggggauu

SEQ ID NO: 368 - RNA, 20 nt, Artificial Sequence
  synthesized
cugacccucaaauccccugc

SEQ ID NO: 369 - RNA, 20 nt, Artificial Sequence
  synthesized
cugacccucacauccccugc

SEQ ID NO: 370 - RNA, 20 nt, Artificial Sequence
  synthesized
cugaguccagcaggggaugu

SEQ ID NO: 371 - RNA, 20 nt, Artificial Sequence
  synthesized
cugaguccagcaggggauuu

SEQ ID NO: 372 - RNA, 20 nt, Artificial Sequence
  synthesized
gaguccagcaggggauguga

SEQ ID NO: 373 - RNA, 20 nt, Artificial Sequence
  synthesized
gaguccagcaggggauuuga

SEQ ID NO: 374 - RNA, 20 nt, Artificial Sequence
  synthesized
gcaggggauuugagggucag

SEQ ID NO: 375 - RNA, 20 nt, Artificial Sequence
  synthesized
ucaaauccccugcuggacuc

SEQ ID NO: 376 - RNA, 20 nt, Artificial Sequence
  synthesized
ugacccucaaauccccugcu

SEQ ID NO: 377 - RNA, 20 nt, Artificial Sequence
  synthesized
ugacccucacauccccugcu

SEQ ID NO: 378 - RNA, 20 nt, Artificial Sequence
  synthesized
ugaguccagcaggggaugug

SEQ ID NO: 379 - RNA, 20 nt, Artificial Sequence
  synthesized
ugaguccagcaggggauuug

SEQ ID NO: 380 - RNA, 20 nt, Artificial Sequence
  synthesized
caucuggagcccagccaggu

SEQ ID NO: 381 - RNA, 20 nt, Artificial Sequence
  synthesized
ggagggcaucuggagcccag

SEQ ID NO: 382 - RNA, 20 nt, Artificial Sequence
  synthesized
ggcugggagggcaucuggag

SEQ ID NO: 383 - RNA, 20 nt, Artificial Sequence
  synthesized
ggcugggcuccagaugcccu

SEQ ID NO: 384 - RNA, 20 nt, Artificial Sequence
  synthesized
gggugggcugggagggcauc

SEQ ID NO: 385 - RNA, 20 nt, Artificial Sequence
  synthesized
ggugggcugggagggcaucu

SEQ ID NO: 386 - RNA, 20 nt, Artificial Sequence
  synthesized
ucuggagcccagccagguag

SEQ ID NO: 387 - RNA, 20 nt, Artificial Sequence
  synthesized
accggagccucccagagcag

SEQ ID NO: 388 - RNA, 20 nt, Artificial Sequence
  synthesized
agcagaggguaagagucccc

SEQ ID NO: 389 - RNA, 20 nt, Artificial Sequence
  synthesized
agccucccagagcagagggu

SEQ ID NO: 390 - RNA, 20 nt, Artificial Sequence
  synthesized
agcggaggguaagagucccc

SEQ ID NO: 391 - RNA, 20 nt, Artificial Sequence
  synthesized
cccucugcucugggaggcuc

SEQ ID NO: 392 - RNA, 20 nt, Artificial Sequence
  synthesized
ccucugcucugggaggcucc

SEQ ID NO: 393 - RNA, 20 nt, Artificial Sequence
  synthesized
cucuuacccucugcucuggg

SEQ ID NO: 394 - RNA, 20 nt, Artificial Sequence
  synthesized
gacucuuacccucugcucug

SEQ ID NO: 395 - RNA, 20 nt, Artificial Sequence
  synthesized
gccucccagagcagagggua

SEQ ID NO: 396 - RNA, 20 nt, Artificial Sequence
  synthesized
ggacucuuacccucugcucu

SEQ ID NO: 397 - RNA, 20 nt, Artificial Sequence
  synthesized
gggacucuuacccucugcuc

SEQ ID NO: 398 - RNA, 20 nt, Artificial Sequence
  synthesized
uaccggagccucccagagca

SEQ ID NO: 399 - RNA, 20 nt, Artificial Sequence
  synthesized
ucugcucugggaggcuccgg

SEQ ID NO: 400 - RNA, 20 nt, Artificial Sequence
  synthesized
agcagcaccgaaugcaucac

SEQ ID NO: 401 - RNA, 20 nt, Artificial Sequence
  synthesized
agcagcaccgagugcaucac

SEQ ID NO: 402 - RNA, 20 nt, Artificial Sequence
  synthesized
agugaucauggugaugcacu

SEQ ID NO: 403 - RNA, 20 nt, Artificial Sequence
  synthesized
agugaucauggugaugcauu

SEQ ID NO: 404 - RNA, 20 nt, Artificial Sequence
  synthesized
augcacucggugcugcuggg

SEQ ID NO: 405 - RNA, 20 nt, Artificial Sequence
  synthesized
augcauucggugcugcuggg

SEQ ID NO: 406 - RNA, 20 nt, Artificial Sequence
  synthesized
cacucggugcugcugggugg

SEQ ID NO: 407 - RNA, 20 nt, Artificial Sequence
  synthesized
cagcaccgaaugcaucacca

SEQ ID NO: 408 - RNA, 20 nt, Artificial Sequence
  synthesized
cagcaccgagugcaucacca

SEQ ID NO: 409 - RNA, 20 nt, Artificial Sequence
  synthesized
cauucggugcugcugggugg

SEQ ID NO: 410 - RNA, 20 nt, Artificial Sequence
  synthesized
ccacccagcagcaccgaaug

SEQ ID NO: 411 - RNA, 20 nt, Artificial Sequence
  synthesized
ccacccagcagcaccgagug

SEQ ID NO: 412 - RNA, 20 nt, Artificial Sequence
  synthesized
cucggugcugcuggguggcg

SEQ ID NO: 413 - RNA, 20 nt, Artificial Sequence
  synthesized
ggugaugcacucggugcugc

SEQ ID NO: 414 - RNA, 20 nt, Artificial Sequence
  synthesized
ggugaugcauucggugcugc

SEQ ID NO: 415 - RNA, 20 nt, Artificial Sequence
  synthesized
gugaucauggugaugcacuc

SEQ ID NO: 416 - RNA, 20 nt, Artificial Sequence
  synthesized
gugaucauggugaugcauuc

SEQ ID NO: 417 - RNA, 20 nt, Artificial Sequence
  synthesized
gugaugcacucggugcugcu

SEQ ID NO: 418 - RNA, 20 nt, Artificial Sequence
  synthesized
gugaugcauucggugcugcu

SEQ ID NO: 419 - RNA, 20 nt, Artificial Sequence
  synthesized
ugaugcacucggugcugcug

SEQ ID NO: 420 - RNA, 20 nt, Artificial Sequence
  synthesized
ugaugcauucggugcugcug

SEQ ID NO: 421 - RNA, 20 nt, Artificial Sequence
  synthesized
ugcacucggugcugcugggu

SEQ ID NO: 422 - RNA, 20 nt, Artificial Sequence
  synthesized
ugcauucggugcugcugggu

SEQ ID NO: 423 - RNA, 20 nt, Artificial Sequence
  synthesized
uucggugcugcuggguggcg

SEQ ID NO: 424 - RNA, 20 nt, Artificial Sequence
  synthesized
aaacaccugguauuaaaagg

SEQ ID NO: 425 - RNA, 20 nt, Artificial Sequence
  synthesized
aaacaccugguauuaaaugg

SEQ ID NO: 426 - RNA, 20 nt, Artificial Sequence
  synthesized
accugguauuaaaaggugau

SEQ ID NO: 427 - RNA, 20 nt, Artificial Sequence
  synthesized
accugguauuaaauggugau

SEQ ID NO: 428 - RNA, 20 nt, Artificial Sequence
  synthesized
aggugaucgaguucauuaau

SEQ ID NO: 429 - RNA, 20 nt, Artificial Sequence
  synthesized
auuaaaaggugaucgaguuc

SEQ ID NO: 430 - RNA, 20 nt, Artificial Sequence
  synthesized
auuaaauggugaucgaguuc

SEQ ID NO: 431 - RNA, 20 nt, Artificial Sequence
  synthesized
auuaaugaacucgaucacca

SEQ ID NO: 432 - RNA, 20 nt, Artificial Sequence
  synthesized
auuaaugaacucgaucaccu

SEQ ID NO: 433 - RNA, 20 nt, Artificial Sequence
  synthesized
cucgaucaccauuuaauacc

SEQ ID NO: 434 - RNA, 20 nt, Artificial Sequence
  synthesized
ucgaucaccauuuaauacca

SEQ ID NO: 435 - RNA, 20 nt, Artificial Sequence
  synthesized
uggugaucgaguucauuaau

SEQ ID NO: 436 - RNA, 20 nt, Artificial Sequence
  synthesized
ugggugacaaagugagacuc

SEQ ID NO: 437 - RNA, 20 nt, Artificial Sequence
  synthesized
acgcgggaccgcagagcccg

SEQ ID NO: 438 - RNA, 20 nt, Artificial Sequence
  synthesized
agcccaccacgcgggaccgc

SEQ ID NO: 439 - RNA, 20 nt, Artificial Sequence
  synthesized
agcccaccgcgcgggaccgc

SEQ ID NO: 440 - RNA, 20 nt, Artificial Sequence
  synthesized
agggacggagcccaccacgc

SEQ ID NO: 441 - RNA, 20 nt, Artificial Sequence
  synthesized
agggacggagcccaccgcgc

SEQ ID NO: 442 - RNA, 20 nt, Artificial Sequence
  synthesized
cacgcgggaccgcagagccc

SEQ ID NO: 443 - RNA, 20 nt, Artificial Sequence
  synthesized
cagggacggagcccaccacg

SEQ ID NO: 444 - RNA, 20 nt, Artificial Sequence
  synthesized
cagggacggagcccaccgcg

SEQ ID NO: 445 - RNA, 20 nt, Artificial Sequence
  synthesized
ccacgcgggaccgcagagcc

SEQ ID NO: 446 - RNA, 20 nt, Artificial Sequence
  synthesized
ccgcgcgggaccgcagagcc

SEQ ID NO: 447 - RNA, 20 nt, Artificial Sequence
  synthesized
cgcgcgggaccgcagagccc

SEQ ID NO: 448 - RNA, 20 nt, Artificial Sequence
  synthesized
cgcggugggcuccgucccug

SEQ ID NO: 449 - RNA, 20 nt, Artificial Sequence
  synthesized
cgggcucugcggucccgcgc

SEQ ID NO: 450 - RNA, 20 nt, Artificial Sequence
  synthesized
cgggcucugcggucccgcgu

SEQ ID NO: 451 - RNA, 20 nt, Artificial Sequence
  synthesized
cguggugggcuccgucccug

SEQ ID NO: 452 - RNA, 20 nt, Artificial Sequence
  synthesized
cugcggucccgcgcgguggg

SEQ ID NO: 453 - RNA, 20 nt, Artificial Sequence
  synthesized
cugcggucccgcgugguggg

SEQ ID NO: 454 - RNA, 20 nt, Artificial Sequence
  synthesized
gagcccaccacgcgggaccg

SEQ ID NO: 455 - RNA, 20 nt, Artificial Sequence
  synthesized
gagcccaccgcgcgggaccg

SEQ ID NO: 456 - RNA, 20 nt, Artificial Sequence
  synthesized
gcgcgggaccgcagagcccg

SEQ ID NO: 457 - RNA, 20 nt, Artificial Sequence
  synthesized
gcucugcggucccgcgcggu

SEQ ID NO: 458 - RNA, 20 nt, Artificial Sequence
  synthesized
gcucugcggucccgcguggu

SEQ ID NO: 459 - RNA, 20 nt, Artificial Sequence
  synthesized
ggacggagcccaccacgcgg

SEQ ID NO: 460 - RNA, 20 nt, Artificial Sequence
  synthesized
ggacggagcccaccgcgcgg

SEQ ID NO: 461 - RNA, 20 nt, Artificial Sequence
  synthesized
ggcagggacggagcccacca

SEQ ID NO: 462 - RNA, 20 nt, Artificial Sequence
  synthesized
ggcucugcggucccgcgcgg

SEQ ID NO: 463 - RNA, 20 nt, Artificial Sequence
  synthesized
ggcucugcggucccgcgugg

SEQ ID NO: 464 - RNA, 20 nt, Artificial Sequence
  synthesized
gggacggagcccaccacgcg

SEQ ID NO: 465 - RNA, 20 nt, Artificial Sequence
  synthesized
gggacggagcccaccgcgcg

SEQ ID NO: 466 - RNA, 20 nt, Artificial Sequence
  synthesized
uguucuucuccuuagggucu

SEQ ID NO: 467 - RNA, 20 nt, Artificial Sequence
  synthesized
uuguucuucuccuuaggguc

SEQ ID NO: 468 - RNA, 20 nt, Artificial Sequence
  synthesized
uuuguucuucuccuuagggu

SEQ ID NO: 469 - RNA, 20 nt, Artificial Sequence
  synthesized
agccagguagaguggccccc

SEQ ID NO: 470 - RNA, 20 nt, Artificial Sequence
  synthesized
agccagguagaguggccucc

SEQ ID NO: 471 - RNA, 20 nt, Artificial Sequence
  synthesized
caccuggaggccacucuacc

SEQ ID NO: 472 - RNA, 20 nt, Artificial Sequence
  synthesized
caccugggggccacucuacc

SEQ ID NO: 473 - RNA, 20 nt, Artificial Sequence
  synthesized
caggcagugaggucaccugg

SEQ ID NO: 474 - RNA, 20 nt, Artificial Sequence
  synthesized
cagguagaguggcccccagg

SEQ ID NO: 475 - RNA, 20 nt, Artificial Sequence
  synthesized
cuccaggugaccucacugcc

SEQ ID NO: 476 - RNA, 20 nt, Artificial Sequence
  synthesized
gcaggcagugaggucaccug

SEQ ID NO: 477 - RNA, 20 nt, Artificial Sequence
  synthesized
gccagguagaguggccccca

SEQ ID NO: 478 - RNA, 20 nt, Artificial Sequence
  synthesized
gccagguagaguggccucca

SEQ ID NO: 479 - RNA, 20 nt, Artificial Sequence
  synthesized
ggaggccacucuaccuggcu

SEQ ID NO: 480 - RNA, 20 nt, Artificial Sequence
  synthesized
ggcaggcagugaggucaccu

SEQ ID NO: 481 - RNA, 20 nt, Artificial Sequence
  synthesized
uggaggccacucuaccuggc

SEQ ID NO: 482 - RNA, 20 nt, Artificial Sequence
  synthesized
uggcaggcagugaggucacc

SEQ ID NO: 483 - RNA, 20 nt, Artificial Sequence
  synthesized
ugggggccacucuaccuggc

SEQ ID NO: 484 - RNA, 20 nt, Artificial Sequence
  synthesized
uguguuucuccuuagggucu

SEQ ID NO: 485 - RNA, 20 nt, Artificial Sequence
  synthesized
uuguguuucuccuuaggguc

SEQ ID NO: 486 - RNA, 20 nt, Artificial Sequence
  synthesized
uuuguguuucuccuuagggu

SEQ ID NO: 487 - RNA, 20 nt, Artificial Sequence
  synthesized
aaauuuagagcuccugggcu

SEQ ID NO: 488 - RNA, 20 nt, Artificial Sequence
  synthesized
aaauuuggagcuccugggcu

SEQ ID NO: 489 - RNA, 20 nt, Artificial Sequence
  synthesized
aguagaaauuuagagcuccu

SEQ ID NO: 490 - RNA, 20 nt, Artificial Sequence
  synthesized
aguagaaauuuggagcuccu

SEQ ID NO: 491 - RNA, 20 nt, Artificial Sequence
  synthesized
auuuagagcuccugggcuuc

SEQ ID NO: 492 - RNA, 20 nt, Artificial Sequence
  synthesized
auuuggagcuccugggcuuc

SEQ ID NO: 493 - RNA, 20 nt, Artificial Sequence
  synthesized
gaguagaaauuuagagcucc

SEQ ID NO: 494 - RNA, 20 nt, Artificial Sequence
  synthesized
gaguagaaauuuggagcucc

SEQ ID NO: 495 - RNA, 20 nt, Artificial Sequence
  synthesized
gcuccaaauuucuacucucu

SEQ ID NO: 496 - RNA, 20 nt, Artificial Sequence
  synthesized
gcucuaaauuucuacucucu

SEQ ID NO: 497 - RNA, 20 nt, Artificial Sequence
  synthesized
ggagcuccaaauuucuacuc

SEQ ID NO: 498 - RNA, 20 nt, Artificial Sequence
  synthesized
ggagcucuaaauuucuacuc

SEQ ID NO: 499 - RNA, 20 nt, Artificial Sequence
  synthesized
aauggaggggggaggggugc

SEQ ID NO: 500 - RNA, 20 nt, Artificial Sequence
  synthesized
agaggauuggagguguccaa

SEQ ID NO: 501 - RNA, 20 nt, Artificial Sequence
  synthesized
agaggauuggagguguccag

SEQ ID NO: 502 - RNA, 20 nt, Artificial Sequence
  synthesized
agguguccaauggagggggg

SEQ ID NO: 503 - RNA, 20 nt, Artificial Sequence
  synthesized
agguguccaguggagggggg

SEQ ID NO: 504 - RNA, 20 nt, Artificial Sequence
  synthesized
aguggaggggggaggggugc

SEQ ID NO: 505 - RNA, 20 nt, Artificial Sequence
  synthesized
auuggagguguccaauggag

SEQ ID NO: 506 - RNA, 20 nt, Artificial Sequence
  synthesized
auuggagguguccaguggag

SEQ ID NO: 507 - RNA, 20 nt, Artificial Sequence
  synthesized
cugcaccccuccccccucca

SEQ ID NO: 508 - RNA, 20 nt, Artificial Sequence
  synthesized
cuggacaccuccaauccucu

SEQ ID NO: 509 - RNA, 20 nt, Artificial Sequence
  synthesized
gaggauuggagguguccaau

SEQ ID NO: 510 - RNA, 20 nt, Artificial Sequence
  synthesized
gaggauuggagguguccagu

SEQ ID NO: 511 - RNA, 20 nt, Artificial Sequence
  synthesized
gauuggagguguccaaugga

SEQ ID NO: 512 - RNA, 20 nt, Artificial Sequence
  synthesized
gcaccccuccccccuccauu

SEQ ID NO: 513 - RNA, 20 nt, Artificial Sequence
  synthesized
ggagguguccaauggagggg

SEQ ID NO: 514 - RNA, 20 nt, Artificial Sequence
  synthesized
ggagguguccaguggagggg

SEQ ID NO: 515 - RNA, 20 nt, Artificial Sequence
  synthesized
ggauuggagguguccaaugg

SEQ ID NO: 516 - RNA, 20 nt, Artificial Sequence
  synthesized
ggauuggagguguccagugg

SEQ ID NO: 517 - RNA, 20 nt, Artificial Sequence
  synthesized
gguguccaauggagggggga

SEQ ID NO: 518 - RNA, 20 nt, Artificial Sequence
  synthesized
gguguccaguggagggggga

SEQ ID NO: 519 - RNA, 20 nt, Artificial Sequence
  synthesized
guguccaguggaggggggag

SEQ ID NO: 520 - RNA, 20 nt, Artificial Sequence
  synthesized
uccccccuccacuggacacc

SEQ ID NO: 521 - RNA, 20 nt, Artificial Sequence
  synthesized
uccccccuccauuggacacc

SEQ ID NO: 522 - RNA, 20 nt, Artificial Sequence
  synthesized
ugcaccccuccccccuccac

SEQ ID NO: 523 - RNA, 20 nt, Artificial Sequence
  synthesized
ugcaccccuccccccuccau

SEQ ID NO: 524 - RNA, 20 nt, Artificial Sequence
  synthesized
uggagguguccaauggaggg

SEQ ID NO: 525 - RNA, 20 nt, Artificial Sequence
  synthesized
uggagguguccaguggaggg

SEQ ID NO: 526 - RNA, 20 nt, Artificial Sequence
  synthesized
uguccaauggaggggggagg

SEQ ID NO: 527 - RNA, 20 nt, Artificial Sequence
  synthesized
uuggacaccuccaauccucu

SEQ ID NO: 528 - RNA, 20 nt, Artificial Sequence
  synthesized
uuggagguguccaauggagg

SEQ ID NO: 529 - RNA, 20 nt, Artificial Sequence
  synthesized
uuggagguguccaguggagg

SEQ ID NO: 530 - RNA, 20 nt, Artificial Sequence
  synthesized
aaaugcugaggggcagggac

SEQ ID NO: 531 - RNA, 20 nt, Artificial Sequence
  synthesized
acagaggcucugaccaggcc

SEQ ID NO: 532 - RNA, 20 nt, Artificial Sequence
  synthesized
aggggcagggacagaggcuc

SEQ ID NO: 533 - RNA, 20 nt, Artificial Sequence
  synthesized
aggggcagggccagaggcuc

SEQ ID NO: 534 - RNA, 20 nt, Artificial Sequence
  synthesized
augcugaggggcagggacag

SEQ ID NO: 535 - RNA, 20 nt, Artificial Sequence
  synthesized
cagagccucuggcccugccc

SEQ ID NO: 536 - RNA, 20 nt, Artificial Sequence
  synthesized
cagggacagaggcucugacc

SEQ ID NO: 537 - RNA, 20 nt, Artificial Sequence
  synthesized
cagggccagaggcucugacc

SEQ ID NO: 538 - RNA, 20 nt, Artificial Sequence
  synthesized
ccagaggcucugaccaggcc

SEQ ID NO: 539 - RNA, 20 nt, Artificial Sequence
  synthesized
cugucccugccccucagcau

SEQ ID NO: 540 - RNA, 20 nt, Artificial Sequence
  synthesized
gacagaggcucugaccaggc

SEQ ID NO: 541 - RNA, 20 nt, Artificial Sequence
  synthesized
gccagaggcucugaccaggc

SEQ ID NO: 542 - RNA, 20 nt, Artificial Sequence
  synthesized
ggcagggacagaggcucuga

SEQ ID NO: 543 - RNA, 20 nt, Artificial Sequence
  synthesized
ggcagggccagaggcucuga

SEQ ID NO: 544 - RNA, 20 nt, Artificial Sequence
  synthesized
ugaggggcagggccagaggc

SEQ ID NO: 545 - RNA, 20 nt, Artificial Sequence
  synthesized
cuugggaggcugagguggga

SEQ ID NO: 546 - RNA, 20 nt, Artificial Sequence
  synthesized
ggcucacacaguccucccac

SEQ ID NO: 547 - RNA, 20 nt, Artificial Sequence
  synthesized
ugggaggacugugugagccc

SEQ ID NO: 548 - RNA, 20 nt, Artificial Sequence
  synthesized
aucuguccauggacccuaga

SEQ ID NO: 549 - RNA, 20 nt, Artificial Sequence
  synthesized
aucuguccguggacccuaga

SEQ ID NO: 550 - RNA, 20 nt, Artificial Sequence
  synthesized
auggacccuagaggaaaauu

SEQ ID NO: 551 - RNA, 20 nt, Artificial Sequence
  synthesized
cacggacagauggguaauau

SEQ ID NO: 552 - RNA, 20 nt, Artificial Sequence
  synthesized
caucuguccauggacccuag

SEQ ID NO: 553 - RNA, 20 nt, Artificial Sequence
  synthesized
caucuguccguggacccuag

SEQ ID NO: 554 - RNA, 20 nt, Artificial Sequence
  synthesized
cauggacagauggguaauau

SEQ ID NO: 555 - RNA, 20 nt, Artificial Sequence
  synthesized
cauggacccuagaggaaaau

SEQ ID NO: 556 - RNA, 20 nt, Artificial Sequence
  synthesized
cccaucuguccauggacccu

SEQ ID NO: 557 - RNA, 20 nt, Artificial Sequence
  synthesized
cccaucuguccguggacccu

SEQ ID NO: 558 - RNA, 20 nt, Artificial Sequence
  synthesized
ccucuaggguccacggacag

SEQ ID NO: 559 - RNA, 20 nt, Artificial Sequence
  synthesized
ccucuaggguccauggacag

SEQ ID NO: 560 - RNA, 20 nt, Artificial Sequence
  synthesized
cguggacccuagaggaaaau

SEQ ID NO: 561 - RNA, 20 nt, Artificial Sequence
  synthesized
cuaggguccacggacagaug

SEQ ID NO: 562 - RNA, 20 nt, Artificial Sequence
  synthesized
cuaggguccauggacagaug

SEQ ID NO: 563 - RNA, 20 nt, Artificial Sequence
  synthesized
cuauauuacccaucugucca

SEQ ID NO: 564 - RNA, 20 nt, Artificial Sequence
  synthesized
cuauauuacccaucuguccg

SEQ ID NO: 565 - RNA, 20 nt, Artificial Sequence
  synthesized
cucuaggguccacggacaga

SEQ ID NO: 566 - RNA, 20 nt, Artificial Sequence
  synthesized
cucuaggguccauggacaga

SEQ ID NO: 567 - RNA, 20 nt, Artificial Sequence
  synthesized
uauauuacccaucuguccau

SEQ ID NO: 568 - RNA, 20 nt, Artificial Sequence
  synthesized
uauauuacccaucuguccgu

SEQ ID NO: 569 - RNA, 20 nt, Artificial Sequence
  synthesized
ucuaggguccacggacagau

SEQ ID NO: 570 - RNA, 20 nt, Artificial Sequence
  synthesized
ucuaggguccauggacagau

SEQ ID NO: 571 - RNA, 20 nt, Artificial Sequence
  synthesized
uuccucuaggguccacggac

SEQ ID NO: 572 - RNA, 20 nt, Artificial Sequence
  synthesized
uuccucuaggguccauggac

SEQ ID NO: 573 - RNA, 20 nt, Artificial Sequence
  synthesized
acaauaggugaaucugugua

SEQ ID NO: 574 - RNA, 20 nt, Artificial Sequence
  synthesized
aucuggguaaacagccugug

SEQ ID NO: 575 - RNA, 20 nt, Artificial Sequence
  synthesized
aucuguguaaacagccugug

SEQ ID NO: 576 - RNA, 20 nt, Artificial Sequence
  synthesized
cacucacaggcuguuuacac

SEQ ID NO: 577 - RNA, 20 nt, Artificial Sequence
  synthesized
cacucacaggcuguuuaccc

SEQ ID NO: 578 - RNA, 20 nt, Artificial Sequence
  synthesized
cucacaggcuguuuacacag

SEQ ID NO: 579 - RNA, 20 nt, Artificial Sequence
  synthesized
cucacaggcuguuuacccag

SEQ ID NO: 580 - RNA, 20 nt, Artificial Sequence
  synthesized
gaaucuggguaaacagccug

SEQ ID NO: 581 - RNA, 20 nt, Artificial Sequence
  synthesized
gaaucuguguaaacagccug

SEQ ID NO: 582 - RNA, 20 nt, Artificial Sequence
  synthesized
gugaaucuggguaaacagcc

SEQ ID NO: 583 - RNA, 20 nt, Artificial Sequence
  synthesized
gugaaucuguguaaacagcc

SEQ ID NO: 584 - RNA, 20 nt, Artificial Sequence
  synthesized
ccccgguaaggggucacagg

SEQ ID NO: 585 - RNA, 20 nt, Artificial Sequence
  synthesized
ccccggugaggggucacagg

SEQ ID NO: 586 - RNA, 20 nt, Artificial Sequence
  synthesized
ccggcccugugaccccucac

SEQ ID NO: 587 - RNA, 20 nt, Artificial Sequence
  synthesized
ccggcccugugaccccuuac

SEQ ID NO: 588 - RNA, 20 nt, Artificial Sequence
  synthesized
ccgguaaggggucacagggc

SEQ ID NO: 589 - RNA, 20 nt, Artificial Sequence
  synthesized
ccggugaggggucacagggc

SEQ ID NO: 590 - RNA, 20 nt, Artificial Sequence
  synthesized
ccucaccgggggccgugggc

SEQ ID NO: 591 - RNA, 20 nt, Artificial Sequence
  synthesized
ccuuaccgggggccgugggc

SEQ ID NO: 592 - RNA, 20 nt, Artificial Sequence
  synthesized
cggcccccgguaagggguca

SEQ ID NO: 593 - RNA, 20 nt, Artificial Sequence
  synthesized
cggcccccggugagggguca

SEQ ID NO: 594 - RNA, 20 nt, Artificial Sequence
  synthesized
cggcccugugaccccucacc

SEQ ID NO: 595 - RNA, 20 nt, Artificial Sequence
  synthesized
cggcccugugaccccuuacc

SEQ ID NO: 596 - RNA, 20 nt, Artificial Sequence
  synthesized
cgggcccacggcccccggua

SEQ ID NO: 597 - RNA, 20 nt, Artificial Sequence
  synthesized
cgggcccacggcccccggug

SEQ ID NO: 598 - RNA, 20 nt, Artificial Sequence
  synthesized
cucaccgggggccgugggcc

SEQ ID NO: 599 - RNA, 20 nt, Artificial Sequence
  synthesized
cuuaccgggggccgugggcc

SEQ ID NO: 600 - RNA, 20 nt, Artificial Sequence
  synthesized
gaccccucaccgggggccgu

SEQ ID NO: 601 - RNA, 20 nt, Artificial Sequence
  synthesized
gaccccuuaccgggggccgu

SEQ ID NO: 602 - RNA, 20 nt, Artificial Sequence
  synthesized
gcccacggcccccgguaagg

SEQ ID NO: 603 - RNA, 20 nt, Artificial Sequence
  synthesized
gcccacggcccccggugagg

SEQ ID NO: 604 - RNA, 20 nt, Artificial Sequence
  synthesized
gcccccgguaaggggucaca

SEQ ID NO: 605 - RNA, 20 nt, Artificial Sequence
  synthesized
gcccccggugaggggucaca

SEQ ID NO: 606 - RNA, 20 nt, Artificial Sequence
  synthesized
gcccugugaccccucaccgg

SEQ ID NO: 607 - RNA, 20 nt, Artificial Sequence
  synthesized
gcccugugaccccuuaccgg

SEQ ID NO: 608 - RNA, 20 nt, Artificial Sequence
  synthesized
ggcccacggcccccgguaag

SEQ ID NO: 609 - RNA, 20 nt, Artificial Sequence
  synthesized
ggcccacggcccccggugag

SEQ ID NO: 610 - RNA, 20 nt, Artificial Sequence
  synthesized
ggcccccgguaaggggucac

SEQ ID NO: 611 - RNA, 20 nt, Artificial Sequence
  synthesized
ggcccccggugaggggucac

SEQ ID NO: 612 - RNA, 20 nt, Artificial Sequence
  synthesized
ggcccugugaccccucaccg

SEQ ID NO: 613 - RNA, 20 nt, Artificial Sequence
  synthesized
ggcccugugaccccuuaccg

SEQ ID NO: 614 - RNA, 20 nt, Artificial Sequence
  synthesized
gggcccacggcccccgguaa

SEQ ID NO: 615 - RNA, 20 nt, Artificial Sequence
  synthesized
gggcccacggcccccgguga

SEQ ID NO: 616 - RNA, 20 nt, Artificial Sequence
  synthesized
gugaccccucaccgggggcc

SEQ ID NO: 617 - RNA, 20 nt, Artificial Sequence
  synthesized
gugaccccuuaccgggggcc

SEQ ID NO: 618 - RNA, 20 nt, Artificial Sequence
  synthesized
ugaccccucaccgggggccg

SEQ ID NO: 619 - RNA, 20 nt, Artificial Sequence
  synthesized
ugaccccuuaccgggggccg

SEQ ID NO: 620 - RNA, 20 nt, Artificial Sequence
  synthesized
ugugaccccucaccgggggc

SEQ ID NO: 621 - RNA, 20 nt, Artificial Sequence
  synthesized
ugugaccccuuaccgggggc

SEQ ID NO: 622 - RNA, 20 nt, Artificial Sequence
  synthesized
aaggcuccgguagcaccuuc

SEQ ID NO: 623 - RNA, 20 nt, Artificial Sequence
  synthesized
aaggugcuaccggagccucc

SEQ ID NO: 624 - RNA, 20 nt, Artificial Sequence
  synthesized
accggagccuuccagagcgg

SEQ ID NO: 625 - RNA, 20 nt, Artificial Sequence
  synthesized
agccuuccagagcggagggu

SEQ ID NO: 626 - RNA, 20 nt, Artificial Sequence
  synthesized
aggugcuaccggagccuccc

SEQ ID NO: 627 - RNA, 20 nt, Artificial Sequence
  synthesized
aggugcuaccggagccuucc

SEQ ID NO: 628 - RNA, 20 nt, Artificial Sequence
  synthesized
cccuccgcucuggaaggcuc

SEQ ID NO: 629 - RNA, 20 nt, Artificial Sequence
  synthesized
ccggagccuuccagagcgga

SEQ ID NO: 630 - RNA, 20 nt, Artificial Sequence
  synthesized
ccuccgcucuggaaggcucc

SEQ ID NO: 631 - RNA, 20 nt, Artificial Sequence
  synthesized
cuaccggagccuuccagagc

SEQ ID NO: 632 - RNA, 20 nt, Artificial Sequence
  synthesized
cucuuacccuccgcucugga

SEQ ID NO: 633 - RNA, 20 nt, Artificial Sequence
  synthesized
gaggcuccgguagcaccuuc

SEQ ID NO: 634 - RNA, 20 nt, Artificial Sequence
  synthesized
gccuuccagagcggagggua

SEQ ID NO: 635 - RNA, 20 nt, Artificial Sequence
  synthesized
gcuaccggagccuuccagag

SEQ ID NO: 636 - RNA, 20 nt, Artificial Sequence
  synthesized
gugcuaccggagccuuccag

SEQ ID NO: 637 - RNA, 20 nt, Artificial Sequence
  synthesized
uacccuccgcucuggaaggc

SEQ ID NO: 638 - RNA, 20 nt, Artificial Sequence
  synthesized
uaccggagccuuccagagcg

SEQ ID NO: 639 - RNA, 20 nt, Artificial Sequence
  synthesized
uccgcucuggaaggcuccgg

SEQ ID NO: 640 - RNA, 20 nt, Artificial Sequence
  synthesized
cagcugcagcccagccaggu

SEQ ID NO: 641 - RNA, 20 nt, Artificial Sequence
  synthesized
gcugcagcccagccagguag

SEQ ID NO: 642 - RNA, 20 nt, Artificial Sequence
  synthesized
ggcugggagggcagcugcag

SEQ ID NO: 643 - RNA, 20 nt, Artificial Sequence
  synthesized
ggugggcugggagggcagcu

SEQ ID NO: 644 - RNA, 20 nt, Artificial Sequence
  synthesized
ugcagcccagccagguagag

SEQ ID NO: 645 - RNA, 20 nt, Artificial Sequence
  synthesized
uggagcccagccagguagag

SEQ ID NO: 646 - RNA, 20 nt, Artificial Sequence
  synthesized
acagaaaauccucucuccuu

SEQ ID NO: 647 - RNA, 20 nt, Artificial Sequence
  synthesized
augcgguaagcuguggaggu

SEQ ID NO: 648 - RNA, 20 nt, Artificial Sequence
  synthesized
augcgguaagcuguggcggu

SEQ ID NO: 649 - RNA, 20 nt, Artificial Sequence
  synthesized
cgguaagcuguggagguggg

SEQ ID NO: 650 - RNA, 20 nt, Artificial Sequence
  synthesized
cgguaagcuguggcgguggg

SEQ ID NO: 651 - RNA, 20 nt, Artificial Sequence
  synthesized
cgucccccaccgccacagcu

SEQ ID NO: 652 - RNA, 20 nt, Artificial Sequence
  synthesized
cgucccccaccuccacagcu

SEQ ID NO: 653 - RNA, 20 nt, Artificial Sequence
  synthesized
gaugcgguaagcuguggagg

SEQ ID NO: 654 - RNA, 20 nt, Artificial Sequence
  synthesized
gaugcgguaagcuguggcgg

SEQ ID NO: 655 - RNA, 20 nt, Artificial Sequence
  synthesized
gccacagcuuaccgcaucca

SEQ ID NO: 656 - RNA, 20 nt, Artificial Sequence
  synthesized
gcgguaagcuguggaggugg

SEQ ID NO: 657 - RNA, 20 nt, Artificial Sequence
  synthesized
gcgguaagcuguggcggugg

SEQ ID NO: 658 - RNA, 20 nt, Artificial Sequence
  synthesized
gcuguggaggugggggacgc

SEQ ID NO: 659 - RNA, 20 nt, Artificial Sequence
  synthesized
gcuguggcggugggggacgc

SEQ ID NO: 660 - RNA, 20 nt, Artificial Sequence
  synthesized
uccacagcuuaccgcaucca

SEQ ID NO: 661 - RNA, 20 nt, Artificial Sequence
  synthesized
ucccccaccgccacagcuua

SEQ ID NO: 662 - RNA, 20 nt, Artificial Sequence
  synthesized
ucccccaccuccacagcuua

SEQ ID NO: 663 - RNA, 20 nt, Artificial Sequence
  synthesized
ugcgguaagcuguggaggug

SEQ ID NO: 664 - RNA, 20 nt, Artificial Sequence
  synthesized
ugcgguaagcuguggcggug

SEQ ID NO: 665 - RNA, 20 nt, Artificial Sequence
  synthesized
uggaugcgguaagcugugga

SEQ ID NO: 666 - RNA, 20 nt, Artificial Sequence
  synthesized
uggaugcgguaagcuguggc

SEQ ID NO: 667 - RNA, 20 nt, Artificial Sequence
  synthesized
uguggaggugggggacgccg

SEQ ID NO: 668 - RNA, 20 nt, Artificial Sequence
  synthesized
uguggcggugggggacgccg

SEQ ID NO: 669 - RNA, 20 nt, Artificial Sequence
  synthesized
acaaguccugcccccagcag

SEQ ID NO: 670 - RNA, 20 nt, Artificial Sequence
  synthesized
agacggggcugcugggggcg

SEQ ID NO: 671 - RNA, 20 nt, Artificial Sequence
  synthesized
cagguacaaguccugccccc

SEQ ID NO: 672 - RNA, 20 nt, Artificial Sequence
  synthesized
cugggggcaggacuuguacc

SEQ ID NO: 673 - RNA, 20 nt, Artificial Sequence
  synthesized
cugggggcgggacuuguacc

SEQ ID NO: 674 - RNA, 20 nt, Artificial Sequence
  synthesized
gcucagguacaagucccgcc

SEQ ID NO: 675 - RNA, 20 nt, Artificial Sequence
  synthesized
gcucagguacaaguccugcc

SEQ ID NO: 676 - RNA, 20 nt, Artificial Sequence
  synthesized
agggcccagacccuaaggaa

SEQ ID NO: 677 - RNA, 20 nt, Artificial Sequence
  synthesized
aagugagcuuguaccagaaa

SEQ ID NO: 678 - RNA, 20 nt, Artificial Sequence
  synthesized
aagugagcuugugccagaaa

SEQ ID NO: 679 - RNA, 20 nt, Artificial Sequence
  synthesized
agugagcuuguaccagaaau

SEQ ID NO: 680 - RNA, 20 nt, Artificial Sequence
  synthesized
agugagcuugugccagaaau

SEQ ID NO: 681 - RNA, 20 nt, Artificial Sequence
  synthesized
guaggaagugagcuuguacc

SEQ ID NO: 682 - RNA, 20 nt, Artificial Sequence
  synthesized
guaggaagugagcuugugcc

SEQ ID NO: 683 - RNA, 20 nt, Artificial Sequence
  synthesized
uugcugcagacuuccauuuc

SEQ ID NO: 684 - RNA, 20 nt, Artificial Sequence
  synthesized
uuguaccagaaauggaaguc

SEQ ID NO: 685 - RNA, 20 nt, Artificial Sequence
  synthesized
uugugccagaaauggaaguc

SEQ ID NO: 686 - RNA, 20 nt, Artificial Sequence
  synthesized
cagaagaauggcaugaaccc

SEQ ID NO: 687 - RNA, 20 nt, Artificial Sequence
  synthesized
gguucaugccauucuucugc

SEQ ID NO: 688 - RNA, 20 nt, Artificial Sequence
  synthesized
acagggccucgugcuccgaa

SEQ ID NO: 689 - RNA, 20 nt, Artificial Sequence
  synthesized
acagggccucgugcucugaa

SEQ ID NO: 690 - RNA, 20 nt, Artificial Sequence
  synthesized
agcuugggcccuucggagca

SEQ ID NO: 691 - RNA, 20 nt, Artificial Sequence
  synthesized
cacagggccucgugcuccga

SEQ ID NO: 692 - RNA, 20 nt, Artificial Sequence
  synthesized
cacagggccucgugcucuga

SEQ ID NO: 693 - RNA, 20 nt, Artificial Sequence
  synthesized
cccuucagagcacgaggccc

SEQ ID NO: 694 - RNA, 20 nt, Artificial Sequence
  synthesized
cccuucggagcacgaggccc

SEQ ID NO: 695 - RNA, 20 nt, Artificial Sequence
  synthesized
cuugggcccuucagagcacg

SEQ ID NO: 696 - RNA, 20 nt, Artificial Sequence
  synthesized
cuugggcccuucggagcacg

SEQ ID NO: 697 - RNA, 20 nt, Artificial Sequence
  synthesized
ucagagcacgaggcccugug

SEQ ID NO: 698 - RNA, 20 nt, Artificial Sequence
  synthesized
ucggagcacgaggcccugug

SEQ ID NO: 699 - RNA, 20 nt, Artificial Sequence
  synthesized
ugcuccgaagggcccaagcu

SEQ ID NO: 700 - RNA, 20 nt, Artificial Sequence
  synthesized
ugcucugaagggcccaagcu

SEQ ID NO: 701 - RNA, 20 nt, Artificial Sequence
  synthesized
aggccaguucucuugagaag

SEQ ID NO: 702 - RNA, 20 nt, Artificial Sequence
  synthesized
ccaggccaguucucuugaga

SEQ ID NO: 703 - RNA, 20 nt, Artificial Sequence
  synthesized
ccggccgcgccuucuccagc

SEQ ID NO: 704 - RNA, 20 nt, Artificial Sequence
  synthesized
ccgggccaguucucuugaga

SEQ ID NO: 705 - RNA, 20 nt, Artificial Sequence
  synthesized
cgcggccaggccaguucucu

SEQ ID NO: 706 - RNA, 20 nt, Artificial Sequence
  synthesized
cgcggccgggccaguucucu

SEQ ID NO: 707 - RNA, 20 nt, Artificial Sequence
  synthesized
cggccaggccaguucucuug

SEQ ID NO: 708 - RNA, 20 nt, Artificial Sequence
  synthesized
cggccgggccaguucucuug

SEQ ID NO: 709 - RNA, 20 nt, Artificial Sequence
  synthesized
cucaagagaacuggcccggc

SEQ ID NO: 710 - RNA, 20 nt, Artificial Sequence
  synthesized
cucaagagaacuggccuggc

SEQ ID NO: 711 - RNA, 20 nt, Artificial Sequence
  synthesized
cuggccgcgccuucuccagc

SEQ ID NO: 712 - RNA, 20 nt, Artificial Sequence
  synthesized
gggccaguucucuugagaag

SEQ ID NO: 713 - RNA, 20 nt, Artificial Sequence
  synthesized
ucucaagagaacuggcccgg

SEQ ID NO: 714 - RNA, 20 nt, Artificial Sequence
  synthesized
ucucaagagaacuggccugg

SEQ ID NO: 715 - RNA, 20 nt, Artificial Sequence
  synthesized
agugugauggggacaagacg

SEQ ID NO: 716 - RNA, 20 nt, Artificial Sequence
  synthesized
auggggacaagacggggagg

SEQ ID NO: 717 - RNA, 20 nt, Artificial Sequence
  synthesized
ccaucacacucacgcagccc

SEQ ID NO: 718 - RNA, 20 nt, Artificial Sequence
  synthesized
cccaucacacucacgcagcc

SEQ ID NO: 719 - RNA, 20 nt, Artificial Sequence
  synthesized
cccgucacacucacgcagcc

SEQ ID NO: 720 - RNA, 20 nt, Artificial Sequence
  synthesized
ccgggcugcgugagugugac

SEQ ID NO: 721 - RNA, 20 nt, Artificial Sequence
  synthesized
ccgggcugcgugagugugau

SEQ ID NO: 722 - RNA, 20 nt, Artificial Sequence
  synthesized
ccgucacacucacgcagccc

SEQ ID NO: 723 - RNA, 20 nt, Artificial Sequence
  synthesized
ccgucuuguccccaucacac

SEQ ID NO: 724 - RNA, 20 nt, Artificial Sequence
  synthesized
cgggcugcgugagugugacg

SEQ ID NO: 725 - RNA, 20 nt, Artificial Sequence
  synthesized
gagugugauggggacaagac

SEQ ID NO: 726 - RNA, 20 nt, Artificial Sequence
  synthesized
gcgugagugugauggggaca

SEQ ID NO: 727 - RNA, 20 nt, Artificial Sequence
  synthesized
ggcugcgugagugugacggg

SEQ ID NO: 728 - RNA, 20 nt, Artificial Sequence
  synthesized
gggcugcgugagugugacgg

SEQ ID NO: 729 - RNA, 20 nt, Artificial Sequence
  synthesized
gugauggggacaagacgggg

SEQ ID NO: 730 - RNA, 20 nt, Artificial Sequence
  synthesized
ucuuguccccaucacacuca

SEQ ID NO: 731 - RNA, 20 nt, Artificial Sequence
  synthesized
ugagugugauggggacaaga

SEQ ID NO: 732 - RNA, 20 nt, Artificial Sequence
  synthesized
ugauggggacaagacgggga

SEQ ID NO: 733 - RNA, 20 nt, Artificial Sequence
  synthesized
uggggacaagacggggaggu

SEQ ID NO: 734 - RNA, 20 nt, Artificial Sequence
  synthesized
aaauaccacggcacauggcc

SEQ ID NO: 735 - RNA, 20 nt, Artificial Sequence
  synthesized
aaauaccauggcacauggcc

SEQ ID NO: 736 - RNA, 20 nt, Artificial Sequence
  synthesized
aggacccaaauaccacggca

SEQ ID NO: 737 - RNA, 20 nt, Artificial Sequence
  synthesized
aggacccaaauaccauggca

SEQ ID NO: 738 - RNA, 20 nt, Artificial Sequence
  synthesized
aggccaugugccaugguauu

SEQ ID NO: 739 - RNA, 20 nt, Artificial Sequence
  synthesized
aggccaugugccgugguauu

SEQ ID NO: 740 - RNA, 20 nt, Artificial Sequence
  synthesized
augguauuuggguccuggga

SEQ ID NO: 741 - RNA, 20 nt, Artificial Sequence
  synthesized
caggccaugugccaugguau

SEQ ID NO: 742 - RNA, 20 nt, Artificial Sequence
  synthesized
caggccaugugccgugguau

SEQ ID NO: 743 - RNA, 20 nt, Artificial Sequence
  synthesized
gcccagacccuaaggagaag

SEQ ID NO: 744 - RNA, 20 nt, Artificial Sequence
  synthesized
ggcccagacccuaaggagaa

SEQ ID NO: 745 - RNA, 20 nt, Artificial Sequence
  synthesized
ccagacccuaaggagaagca

SEQ ID NO: 746 - RNA, 20 nt, Artificial Sequence
  synthesized
cccagacccuaaggagaagc

SEQ ID NO: 747 - RNA, 20 nt, Artificial Sequence
  synthesized
acccuaaggagaagcacaaa

SEQ ID NO: 748 - RNA, 20 nt, Artificial Sequence
  synthesized
agacccuaaggagaagcaca

SEQ ID NO: 749 - RNA, 20 nt, Artificial Sequence
  synthesized
cagacccuaaggagaagcac

SEQ ID NO: 750 - RNA, 20 nt, Artificial Sequence
  synthesized
cccuaaggagaagcacaaaa

SEQ ID NO: 751 - RNA, 20 nt, Artificial Sequence
  synthesized
gugcuucuccuuagggucug

SEQ ID NO: 752 - RNA, 20 nt, Artificial Sequence
  synthesized
cucucuucuucuuucauacc

SEQ ID NO: 753 - RNA, 20 nt, Artificial Sequence
  synthesized
cucuucuucuuucauaccuc

SEQ ID NO: 754 - RNA, 20 nt, Artificial Sequence
  synthesized
cuucuucuuucauaccucaa

SEQ ID NO: 755 - RNA, 20 nt, Artificial Sequence
  synthesized
ucucucuucuucuuucauac

SEQ ID NO: 756 - RNA, 20 nt, Artificial Sequence
  synthesized
ucucuucuucuuucauaccu

SEQ ID NO: 757 - RNA, 20 nt, Artificial Sequence
  synthesized
ugagguaugaaagaagaaga

SEQ ID NO: 758 - RNA, 20 nt, Artificial Sequence
  synthesized
uugagguaugaaagaagaag

SEQ ID NO: 759 - RNA, 20 nt, Artificial Sequence
  synthesized
cucucucuucuucuuucaua

SEQ ID NO: 760 - RNA, 20 nt, Artificial Sequence
  synthesized
gagguaugaaagaagaagag

SEQ ID NO: 761 - RNA, 20 nt, Artificial Sequence
  synthesized
acuggaggaauaaauaaggg

SEQ ID NO: 762 - RNA, 20 nt, Artificial Sequence
  synthesized
aucuucuuucccagaccucc

SEQ ID NO: 763 - RNA, 20 nt, Artificial Sequence
  synthesized
gacuggaggaauaaauaagg

SEQ ID NO: 764 - RNA, 20 nt, Artificial Sequence
  synthesized
auccagaugucgccacuccc

SEQ ID NO: 765 - RNA, 20 nt, Artificial Sequence
  synthesized
aucuuggugucucggagucu

SEQ ID NO: 766 - RNA, 20 nt, Artificial Sequence
  synthesized
uauccagaugucgccacucc

SEQ ID NO: 767 - RNA, 20 nt, Artificial Sequence
  synthesized
uuauccagaugucgccacuc

SEQ ID NO: 768 - RNA, 20 nt, Artificial Sequence
  synthesized
ggggaagucucgggccucuc

SEQ ID NO: 769 - RNA, 20 nt, Artificial Sequence
  synthesized
guuggggaagucucgggccu

SEQ ID NO: 770 - RNA, 20 nt, Artificial Sequence
  synthesized
uggggaagucucgggccucu

SEQ ID NO: 771 - RNA, 20 nt, Artificial Sequence
  synthesized
uuggggaagucucgggccuc

SEQ ID NO: 772 - RNA, 20 nt, Artificial Sequence
  synthesized
auacgucucggcaauguucc

SEQ ID NO: 773 - RNA, 20 nt, Artificial Sequence
  synthesized
caauacgucucggcaauguu

SEQ ID NO: 774 - RNA, 20 nt, Artificial Sequence
  synthesized
aggguucccagaggucaguu

SEQ ID NO: 775 - RNA, 20 nt, Artificial Sequence
  synthesized
cccugucaauuacuagcuga

SEQ ID NO: 776 - RNA, 20 nt, Artificial Sequence
  synthesized
ccugucaauuacuagcugag

SEQ ID NO: 777 - RNA, 20 nt, Artificial Sequence
  synthesized
cugucaauuacuagcugaga

SEQ ID NO: 778 - RNA, 20 nt, Artificial Sequence
  synthesized
ggguucccagaggucaguug

SEQ ID NO: 779 - RNA, 20 nt, Artificial Sequence
  synthesized
ugaggguucccagaggucag

SEQ ID NO: 780 - RNA, 20 nt, Artificial Sequence
  synthesized
acuccgagacaccaagauuu

SEQ ID NO: 781 - RNA, 20 nt, Artificial Sequence
  synthesized
agacuccgagacaccaagau

SEQ ID NO: 782 - RNA, 20 nt, Artificial Sequence
  synthesized
gacuccgagacaccaagauu

SEQ ID NO: 783 - RNA, 20 nt, Artificial Sequence
  synthesized
gcaggaauauaaaggaaugu

SEQ ID NO: 784 - RNA, 20 nt, Artificial Sequence
  synthesized
aguggagugggcagggcuga

SEQ ID NO: 785 - RNA, 20 nt, Artificial Sequence
  synthesized
gcugagugaaggugggaagg

SEQ ID NO: 786 - RNA, 20 nt, Artificial Sequence
  synthesized
ugagugaaggugggaaggaa

SEQ ID NO: 787 - RNA, 20 nt, Artificial Sequence
  synthesized
caucauguauauaacugacc

SEQ ID NO: 788 - RNA, 20 nt, Artificial Sequence
  synthesized
cauguauauaacugacccuc

SEQ ID NO: 789 - RNA, 20 nt, Artificial Sequence
  synthesized
caggacccccaccgugaaca

SEQ ID NO: 790 - RNA, 20 nt, Artificial Sequence
  synthesized
ggacccccaccgugaacacg

SEQ ID NO: 791 - RNA, 20 nt, Artificial Sequence
  synthesized
ugcugcagccccccgcccuc

SEQ ID NO: 792 - RNA, 20 nt, Artificial Sequence
  synthesized
acugcauugcugggcugugu

SEQ ID NO: 793 - RNA, 20 nt, Artificial Sequence
  synthesized
cugcauugcugggcuguguu

SEQ ID NO: 794 - RNA, 20 nt, Artificial Sequence
  synthesized
ggugcaagguccagaagagc

SEQ ID NO: 795 - RNA, 20 nt, Artificial Sequence
  synthesized
aggcaccugucgaguguauc

SEQ ID NO: 796 - RNA, 20 nt, Artificial Sequence
  synthesized
caggcaccugucgaguguau

SEQ ID NO: 797 - RNA, 20 nt, Artificial Sequence
  synthesized
ccaggcaccugucgagugua

SEQ ID NO: 798 - RNA, 20 nt, Artificial Sequence
  synthesized
ggcaccugucgaguguaucc

SEQ ID NO: 799 - RNA, 20 nt, Artificial Sequence
  synthesized
ggacaccuggcuuggguggg

SEQ ID NO: 800 - RNA, 20 nt, Artificial Sequence
  synthesized
uccccucugcugccugcaga

SEQ ID NO: 801 - RNA, 20 nt, Artificial Sequence
  synthesized
aacuggcugcuucuccugug

SEQ ID NO: 802 - RNA, 20 nt, Artificial Sequence
  synthesized
acuggcugcuucuccugugg

SEQ ID NO: 803 - RNA, 20 nt, Artificial Sequence
  synthesized
cuugggcaaguucccugauu

SEQ ID NO: 804 - RNA, 20 nt, Artificial Sequence
  synthesized
uugggcaaguucccugauua

SEQ ID NO: 805 - RNA, 20 nt, Artificial Sequence
  synthesized
agggguugcaauuucccauc

SEQ ID NO: 806 - RNA, 20 nt, Artificial Sequence
  synthesized
cguagggguugcaauuuccc

SEQ ID NO: 807 - RNA, 20 nt, Artificial Sequence
  synthesized
cucuuggaagaaucuagggg

SEQ ID NO: 808 - RNA, 20 nt, Artificial Sequence
  synthesized
cuuggaagaaucuaggggca

SEQ ID NO: 809 - RNA, 20 nt, Artificial Sequence
  synthesized
guagggguugcaauuuccca

SEQ ID NO: 810 - RNA, 20 nt, Artificial Sequence
  synthesized
ucuuggaagaaucuaggggc

SEQ ID NO: 811 - RNA, 20 nt, Artificial Sequence
  synthesized
agcggagaaucccugacccu

SEQ ID NO: 812 - RNA, 20 nt, Artificial Sequence
  synthesized
cggagaaucccugacccuca

SEQ ID NO: 813 - RNA, 20 nt, Artificial Sequence
  synthesized
gagcccugaguccagcaggg

SEQ ID NO: 814 - RNA, 20 nt, Artificial Sequence
  synthesized
gcggagaaucccugacccuc

SEQ ID NO: 815 - RNA, 20 nt, Artificial Sequence
  synthesized
cacaggggacucuuacccuc

SEQ ID NO: 816 - RNA, 20 nt, Artificial Sequence
  synthesized
cugcacaggggacucuuacc

SEQ ID NO: 817 - RNA, 20 nt, Artificial Sequence
  synthesized
gcacaggggacucuuacccu

SEQ ID NO: 818 - RNA, 20 nt, Artificial Sequence
  synthesized
ugcacaggggacucuuaccc

SEQ ID NO: 819 - RNA, 20 nt, Artificial Sequence
  synthesized
agcagugaucauggugaugc

SEQ ID NO: 820 - RNA, 20 nt, Artificial Sequence
  synthesized
cagcagugaucauggugaug

SEQ ID NO: 821 - RNA, 20 nt, Artificial Sequence
  synthesized
ccucgccacccagcagcacc

SEQ ID NO: 822 - RNA, 20 nt, Artificial Sequence
  synthesized
gcagcagugaucauggugau

SEQ ID NO: 823 - RNA, 20 nt, Artificial Sequence
  synthesized
gcagugaucauggugaugca

SEQ ID NO: 824 - RNA, 20 nt, Artificial Sequence
  synthesized
gauuaaugaacucgaucacc

SEQ ID NO: 825 - RNA, 20 nt, Artificial Sequence
  synthesized
ggauuaaugaacucgaucac

SEQ ID NO: 826 - RNA, 20 nt, Artificial Sequence
  synthesized
gggauuaaugaacucgauca

SEQ ID NO: 827 - RNA, 20 nt, Artificial Sequence
  synthesized
ggggauuaaugaacucgauc

SEQ ID NO: 828 - RNA, 20 nt, Artificial Sequence
  synthesized
accccgggcucugcgguccc

SEQ ID NO: 829 - RNA, 20 nt, Artificial Sequence
  synthesized
cccgggcucugcggucccgc

SEQ ID NO: 830 - RNA, 20 nt, Artificial Sequence
  synthesized
cggggcagggacggagccca

SEQ ID NO: 831 - RNA, 20 nt, Artificial Sequence
  synthesized
gcggggcagggacggagccc

SEQ ID NO: 832 - RNA, 20 nt, Artificial Sequence
  synthesized
gggcagggacggagcccacc

SEQ ID NO: 833 - RNA, 20 nt, Artificial Sequence
  synthesized
agcccagccagguagagugg

SEQ ID NO: 834 - RNA, 20 nt, Artificial Sequence
  synthesized
cccagccagguagaguggcc

SEQ ID NO: 835 - RNA, 20 nt, Artificial Sequence
  synthesized
gagcccagccagguagagug

SEQ ID NO: 836 - RNA, 20 nt, Artificial Sequence
  synthesized
gggccacucuaccuggcugg

SEQ ID NO: 837 - RNA, 20 nt, Artificial Sequence
  synthesized
augaccugaagcccaggagc

SEQ ID NO: 838 - RNA, 20 nt, Artificial Sequence
  synthesized
caugaccugaagcccaggag

SEQ ID NO: 839 - RNA, 20 nt, Artificial Sequence
  synthesized
gaccugaagcccaggagcuc

SEQ ID NO: 840 - RNA, 20 nt, Artificial Sequence
  synthesized
gcaaaucaagagaguagaaa

SEQ ID NO: 841 - RNA, 20 nt, Artificial Sequence
  synthesized
ugaccugaagcccaggagcu

SEQ ID NO: 842 - RNA, 20 nt, Artificial Sequence
  synthesized
aagaggauuggaggugucca

SEQ ID NO: 843 - RNA, 20 nt, Artificial Sequence
  synthesized
cacugcaccccuccccccuc

SEQ ID NO: 844 - RNA, 20 nt, Artificial Sequence
  synthesized
uccaagaggauuggaggugu

SEQ ID NO: 845 - RNA, 20 nt, Artificial Sequence
  synthesized
ccggccuggucagagccucu

SEQ ID NO: 846 - RNA, 20 nt, Artificial Sequence
  synthesized
cggccuggucagagccucug

SEQ ID NO: 847 - RNA, 20 nt, Artificial Sequence
  synthesized
cuccggccuggucagagccu

SEQ ID NO: 848 - RNA, 20 nt, Artificial Sequence
  synthesized
gguggaaaugcugaggggca

SEQ ID NO: 849 - RNA, 20 nt, Artificial Sequence
  synthesized
caucuauauuacccaucugu

SEQ ID NO: 850 - RNA, 20 nt, Artificial Sequence
  synthesized
ucaucuauauuacccaucug

SEQ ID NO: 851 - RNA, 20 nt, Artificial Sequence
  synthesized
aacacucacaggcuguuuac

SEQ ID NO: 852 - RNA, 20 nt, Artificial Sequence
  synthesized
aagaacacucacaggcuguu

SEQ ID NO: 853 - RNA, 20 nt, Artificial Sequence
  synthesized
agaacacucacaggcuguuu

SEQ ID NO: 854 - RNA, 20 nt, Artificial Sequence
  synthesized
gcucgggcccacggcccccg

SEQ ID NO: 855 - RNA, 20 nt, Artificial Sequence
  synthesized
ggaccggcccugugaccccu

SEQ ID NO: 856 - RNA, 20 nt, Artificial Sequence
  synthesized
gggaccggcccugugacccc

SEQ ID NO: 857 - RNA, 20 nt, Artificial Sequence
  synthesized
ggggaccggcccugugaccc

SEQ ID NO: 858 - RNA, 20 nt, Artificial Sequence
  synthesized
ucgggcccacggcccccggu

SEQ ID NO: 859 - RNA, 20 nt, Artificial Sequence
  synthesized
ugcuaccggagccucccaga

SEQ ID NO: 860 - RNA, 20 nt, Artificial Sequence
  synthesized
acccuccgcucugggaggcu

SEQ ID NO: 861 - RNA, 20 nt, Artificial Sequence
  synthesized
cccagagcggaggguaagag

SEQ ID NO: 862 - RNA, 20 nt, Artificial Sequence
  synthesized
ccgcucugggaggcuccggu

SEQ ID NO: 863 - RNA, 20 nt, Artificial Sequence
  synthesized
ccucccagagcggaggguaa

SEQ ID NO: 864 - RNA, 20 nt, Artificial Sequence
  synthesized
cgcucugggaggcuccggua

SEQ ID NO: 865 - RNA, 20 nt, Artificial Sequence
  synthesized
cggagccucccagagcggag

SEQ ID NO: 866 - RNA, 20 nt, Artificial Sequence
  synthesized
cucccagagcggaggguaag

SEQ ID NO: 867 - RNA, 20 nt, Artificial Sequence
  synthesized
cuccgcucugggaggcuccg

SEQ ID NO: 868 - RNA, 20 nt, Artificial Sequence
  synthesized
cuuacccuccgcucugggag

SEQ ID NO: 869 - RNA, 20 nt, Artificial Sequence
  synthesized
gagccucccagagcggaggg

SEQ ID NO: 870 - RNA, 20 nt, Artificial Sequence
  synthesized
ggagccucccagagcggagg

SEQ ID NO: 871 - RNA, 20 nt, Artificial Sequence
  synthesized
ucccagagcggaggguaaga

SEQ ID NO: 872 - RNA, 20 nt, Artificial Sequence
  synthesized
ucuuacccuccgcucuggga

SEQ ID NO: 873 - RNA, 20 nt, Artificial Sequence
  synthesized
uuacccuccgcucugggagg

SEQ ID NO: 874 - RNA, 20 nt, Artificial Sequence
  synthesized
acucuuacccuccgcucugg

SEQ ID NO: 875 - RNA, 20 nt, Artificial Sequence
  synthesized
acagaaggugcuaccggagc

SEQ ID NO: 876 - RNA, 20 nt, Artificial Sequence
  synthesized
agaaggugcuaccggagccu

SEQ ID NO: 877 - RNA, 20 nt, Artificial Sequence
  synthesized
cacagaaggugcuaccggag

SEQ ID NO: 878 - RNA, 20 nt, Artificial Sequence
  synthesized
cagaaggugcuaccggagcc

SEQ ID NO: 879 - RNA, 20 nt, Artificial Sequence
  synthesized
gagagagagagagagagaga

SEQ ID NO: 880 - RNA, 20 nt, Artificial Sequence
  synthesized
agagagagagagagagagag

SEQ ID NO: 881 - RNA, 20 nt, Artificial Sequence
  synthesized
cacucuaccuggcugggcuc

SEQ ID NO: 882 - RNA, 20 nt, Artificial Sequence
  synthesized
cucuaccuggcugggcucca

SEQ ID NO: 883 - RNA, 20 nt, Artificial Sequence
  synthesized
agcuggagcccagccaggua

SEQ ID NO: 884 - RNA, 20 nt, Artificial Sequence
  synthesized
cugggagggcagcuggagcc

SEQ ID NO: 885 - RNA, 20 nt, Artificial Sequence
  synthesized
gcugggcuccagcugcccuc

SEQ ID NO: 886 - RNA, 20 nt, Artificial Sequence
  synthesized
gggagggcagcuggagccca

SEQ ID NO: 887 - RNA, 20 nt, Artificial Sequence
  synthesized
uggcugggcuccagcugccc

SEQ ID NO: 888 - RNA, 20 nt, Artificial Sequence
  synthesized
gccacucuaccuggcugggc

SEQ ID NO: 889 - RNA, 20 nt, Artificial Sequence
  synthesized
ggccacucuaccuggcuggg

SEQ ID NO: 890 - RNA, 20 nt, Artificial Sequence
  synthesized
aguuggacagaaaauccucu

SEQ ID NO: 891 - RNA, 20 nt, Artificial Sequence
  synthesized
caguuggacagaaaauccuc

SEQ ID NO: 892 - RNA, 20 nt, Artificial Sequence
  synthesized
guuggacagaaaauccucuc

SEQ ID NO: 893 - RNA, 20 nt, Artificial Sequence
  synthesized
uuggacagaaaauccucucu

SEQ ID NO: 894 - RNA, 20 nt, Artificial Sequence
  synthesized
agcucacggcgucccccacc

SEQ ID NO: 895 - RNA, 20 nt, Artificial Sequence
  synthesized
cacguggaugcgguaagcug

SEQ ID NO: 896 - RNA, 20 nt, Artificial Sequence
  synthesized
ccgagcucacggcguccccc

SEQ ID NO: 897 - RNA, 20 nt, Artificial Sequence
  synthesized
cgagcucacggcguccccca

SEQ ID NO: 898 - RNA, 20 nt, Artificial Sequence
  synthesized
cguggaugcgguaagcugug

SEQ ID NO: 899 - RNA, 20 nt, Artificial Sequence
  synthesized
aggcagcucagguacaaguc

SEQ ID NO: 900 - RNA, 20 nt, Artificial Sequence
  synthesized
cggagacggggcugcugggg

SEQ ID NO: 901 - RNA, 20 nt, Artificial Sequence
  synthesized
aaaguccuggaaugugcagc

SEQ ID NO: 902 - RNA, 20 nt, Artificial Sequence
  synthesized
aauaggacagcuugggccug

SEQ ID NO: 903 - RNA, 20 nt, Artificial Sequence
  synthesized
aguccuggaaugugcagcuc

SEQ ID NO: 904 - RNA, 20 nt, Artificial Sequence
  synthesized
auaggacagcuugggccugg

SEQ ID NO: 905 - RNA, 20 nt, Artificial Sequence
  synthesized
gaauaggacagcuugggccu

SEQ ID NO: 906 - RNA, 20 nt, Artificial Sequence
  synthesized
guccuggaaugugcagcucc

SEQ ID NO: 907 - RNA, 20 nt, Artificial Sequence
  synthesized
acaggaccuacauccucaga

SEQ ID NO: 908 - RNA, 20 nt, Artificial Sequence
  synthesized
cacaggaccuacauccucag

SEQ ID NO: 909 - RNA, 20 nt, Artificial Sequence
  synthesized
caggaccuacauccucagau

SEQ ID NO: 910 - RNA, 20 nt, Artificial Sequence
  synthesized
ccacaggaccuacauccuca

SEQ ID NO: 911 - RNA, 20 nt, Artificial Sequence
  synthesized
ccuaaggagaagcacaaaaa

SEQ ID NO: 912 - RNA, 20 nt, Artificial Sequence
  synthesized
cuaaggagaagcacaaaaaa

SEQ ID NO: 913 - RNA, 20 nt, Artificial Sequence
  synthesized
gacccuaaggagaagcacaa

SEQ ID NO: 914 - RNA, 20 nt, Artificial Sequence
  synthesized
gcuucuccuuagggucuggg

SEQ ID NO: 915 - RNA, 20 nt, Artificial Sequence
  synthesized
ugcuucuccuuagggucugg

SEQ ID NO: 916 - RNA, 20 nt, Artificial Sequence
  synthesized
cagggcccagacccuaagga

SEQ ID NO: 917 - RNA, 20 nt, Artificial Sequence
  synthesized
cuucuccuuagggucugggc

SEQ ID NO: 918 - RNA, 20 nt, Artificial Sequence
  synthesized
agcagggcccagacccuaag

SEQ ID NO: 919 - RNA, 20 nt, Artificial Sequence
  synthesized
cugcagacuuccauuucugg

SEQ ID NO: 920 - RNA, 20 nt, Artificial Sequence
  synthesized
gcugcagacuuccauuucug

SEQ ID NO: 921 - RNA, 20 nt, Artificial Sequence
  synthesized
gguaaguaggaagugagcuu

SEQ ID NO: 922 - RNA, 20 nt, Artificial Sequence
  synthesized
guaaguaggaagugagcuug

SEQ ID NO: 923 - RNA, 20 nt, Artificial Sequence
  synthesized
uaaguaggaagugagcuugu

SEQ ID NO: 924 - RNA, 20 nt, Artificial Sequence
  synthesized
ugcugcagacuuccauuucu

SEQ ID NO: 925 - RNA, 20 nt, Artificial Sequence
  synthesized
agucacacagggccucgugc

SEQ ID NO: 926 - RNA, 20 nt, Artificial Sequence
  synthesized
auugaaccaagcuugggccc

SEQ ID NO: 927 - RNA, 20 nt, Artificial Sequence
  synthesized
cagucacacagggccucgug

SEQ ID NO: 928 - RNA, 20 nt, Artificial Sequence
  synthesized
gucacacagggccucgugcu

SEQ ID NO: 929 - RNA, 20 nt, Artificial Sequence
  synthesized
uugaaccaagcuugggcccu

SEQ ID NO: 930 - RNA, 20 nt, Artificial Sequence
  synthesized
cacuucucaagagaacuggc

SEQ ID NO: 931 - RNA, 20 nt, Artificial Sequence
  synthesized
cggaagcuggagaaggcgcg

SEQ ID NO: 932 - RNA, 20 nt, Artificial Sequence
  synthesized
cucacuucucaagagaacug

SEQ ID NO: 933 - RNA, 20 nt, Artificial Sequence
  synthesized
caccgggcugcgugagugug

SEQ ID NO: 934 - RNA, 20 nt, Artificial Sequence
  synthesized
ccguggauaccaggccaugu

SEQ ID NO: 935 - RNA, 20 nt, Artificial Sequence
  synthesized
ccucccaggacccaaauacc

SEQ ID NO: 936 - RNA, 20 nt, Artificial Sequence
  synthesized
cguggauaccaggccaugug

SEQ ID NO: 937 - RNA, 20 nt, Artificial Sequence
  synthesized
uggauaccaggccaugugcc

SEQ ID NO: 938 - RNA, 20 nt, Artificial Sequence
  synthesized
cgggccacagcugcuccgga

SEQ ID NO: 939 - RNA, 20 nt, Artificial Sequence
  synthesized
cugccgcagguggcagaugg

SEQ ID NO: 940 - RNA, 20 nt, Artificial Sequence
  synthesized
gccgcagguggcagaugggu

SEQ ID NO: 941 - RNA, 20 nt, Artificial Sequence
  synthesized
ggcgggccacagcugcuccg

SEQ ID NO: 942 - RNA, 20 nt, Artificial Sequence
  synthesized
ugccgcagguggcagauggg

SEQ ID NO: 943 - RNA, 20 nt, Artificial Sequence
  synthesized
aaggugugugucugggggug

SEQ ID NO: 944 - RNA, 20 nt, Artificial Sequence
  synthesized
cccugcccccaggacgucac

SEQ ID NO: 945 - RNA, 20 nt, Artificial Sequence
  synthesized
ccugcccccaggacgucacc

SEQ ID NO: 946 - RNA, 20 nt, Artificial Sequence
  synthesized
cccugaggccaccgcccccu

SEQ ID NO: 947 - RNA, 20 nt, Artificial Sequence
  synthesized
gccgugguugcuggaccugc

SEQ ID NO: 948 - RNA, 20 nt, Artificial Sequence
  synthesized
ucccugaggccaccgccccc

SEQ ID NO: 949 - RNA, 20 nt, Artificial Sequence
  synthesized
ugccgugguugcuggaccug

SEQ ID NO: 950 - RNA, 20 nt, Artificial Sequence
  synthesized
uucccugaggccaccgcccc

SEQ ID NO: 951 - RNA, 20 nt, Artificial Sequence
  synthesized
cuguggccccuccccuggcc

SEQ ID NO: 952 - RNA, 20 nt, Artificial Sequence
  synthesized
gguuuaugcacuggggauga

SEQ ID NO: 953 - RNA, 20 nt, Artificial Sequence
  synthesized
uguggccccuccccuggccc

SEQ ID NO: 954 - RNA, 20 nt, Artificial Sequence
  synthesized
caguggaccccaggcacccc

SEQ ID NO: 955 - RNA, 20 nt, Artificial Sequence
  synthesized
caguucaccccaccuccuca

SEQ ID NO: 956 - RNA, 20 nt, Artificial Sequence
  synthesized
cugcaguggaccccaggcac

SEQ ID NO: 957 - RNA, 20 nt, Artificial Sequence
  synthesized
gcaguggaccccaggcaccc

SEQ ID NO: 958 - RNA, 20 nt, Artificial Sequence
  synthesized
ugcaguggaccccaggcacc

SEQ ID NO: 959 - RNA, 20 nt, Artificial Sequence
  synthesized
agacaucauugaccagggau

SEQ ID NO: 960 - RNA, 20 nt, Artificial Sequence
  synthesized
ccggaauucccucucacugu

SEQ ID NO: 961 - RNA, 20 nt, Artificial Sequence
  synthesized
cggaauucccucucacuguc

SEQ ID NO: 962 - RNA, 20 nt, Artificial Sequence
  synthesized
ggagacaucauugaccaggg

SEQ ID NO: 963 - RNA, 20 nt, Artificial Sequence
  synthesized
uccggaauucccucucacug

SEQ ID NO: 964 - RNA, 20 nt, Artificial Sequence
  synthesized
uuccggaauucccucucacu

SEQ ID NO: 965 - RNA, 20 nt, Artificial Sequence
  synthesized
aagugugguuggugggccag

SEQ ID NO: 966 - RNA, 20 nt, Artificial Sequence
  synthesized
augagcucacaggcagugcc

SEQ ID NO: 967 - RNA, 20 nt, Artificial Sequence
  synthesized
gugugguuggugggccaggg

SEQ ID NO: 968 - RNA, 20 nt, Artificial Sequence
  synthesized
uaaugagcucacaggcagug

SEQ ID NO: 969 - RNA, 20 nt, Artificial Sequence
  synthesized
aucccuuucugacuuagaga

SEQ ID NO: 970 - RNA, 20 nt, Artificial Sequence
  synthesized
cgaucccuuucugacuuaga

SEQ ID NO: 971 - RNA, 20 nt, Artificial Sequence
  synthesized
gggguuuaggaaccagccug

SEQ ID NO: 972 - RNA, 20 nt, Artificial Sequence
  synthesized
ggguuuaggaaccagccugg

SEQ ID NO: 973 - RNA, 20 nt, Artificial Sequence
  synthesized
ucccuuucugacuuagagag

SEQ ID NO: 974 - RNA, 20 nt, Artificial Sequence
  synthesized
caagcuugguucaaugaccu

SEQ ID NO: 975 - RNA, 20 nt, Artificial Sequence
  synthesized
ccaagcuugguucaaugacc

SEQ ID NO: 976 - RNA, 20 nt, Artificial Sequence
  synthesized
cccaagcuugguucaaugac

SEQ ID NO: 977 - RNA, 20 nt, Artificial Sequence
  synthesized
gcccaagcuugguucaauga

SEQ ID NO: 978 - RNA, 20 nt, Artificial Sequence
  synthesized
ucguucauucaugaugaugg

SEQ ID NO: 979 - RNA, 20 nt, Artificial Sequence
  synthesized
uucauucaugaugauggcag

SEQ ID NO: 980 - RNA, 20 nt, Artificial Sequence
  synthesized
ccuugccaacuuugcacuuc

SEQ ID NO: 981 - RNA, 20 nt, Artificial Sequence
  synthesized
cuugccaacuuugcacuuca

SEQ ID NO: 982 - RNA, 20 nt, Artificial Sequence
  synthesized
uugccaacuuugcacuucau

SEQ ID NO: 983 - RNA, 20 nt, Artificial Sequence
  synthesized
aaagcccagugaugaaacuc

SEQ ID NO: 984 - RNA, 20 nt, Artificial Sequence
  synthesized
aagcccagugaugaaacuca

SEQ ID NO: 985 - RNA, 20 nt, Artificial Sequence
  synthesized
cuuuaagggggccuccguau

SEQ ID NO: 986 - RNA, 20 nt, Artificial Sequence
  synthesized
gcuuuaagggggccuccgua

SEQ ID NO: 987 - RNA, 20 nt, Artificial Sequence
  synthesized
uuaagggggccuccguauaa

SEQ ID NO: 988 - RNA, 20 nt, Artificial Sequence
  synthesized
uuuaagggggccuccguaua

SEQ ID NO: 989 - RNA, 20 nt, Artificial Sequence
  synthesized
acccucaccccaagaaaaau

SEQ ID NO: 990 - RNA, 20 nt, Artificial Sequence
  synthesized
cacccucaccccaagaaaaa

SEQ ID NO: 991 - RNA, 20 nt, Artificial Sequence
  synthesized
ccucaccccaagaaaaaucu

SEQ ID NO: 992 - RNA, 20 nt, Artificial Sequence
  synthesized
ggguucacucaggaguagag

SEQ ID NO: 993 - RNA, 20 nt, Artificial Sequence
  synthesized
uucacucaggaguagaggag

SEQ ID NO: 994 - RNA, 20 nt, Artificial Sequence
  synthesized
aucagcacauagcuauccgc

SEQ ID NO: 995 - RNA, 20 nt, Artificial Sequence
  synthesized
ggagaaggccgucuugguug

SEQ ID NO: 996 - RNA, 20 nt, Artificial Sequence
  synthesized
ggaucagcacauagcuaucc

SEQ ID NO: 997 - RNA, 20 nt, Artificial Sequence
  synthesized
ucagcacauagcuauccgcc

SEQ ID NO: 998 - RNA, 20 nt, Artificial Sequence
  synthesized
uggagaaggccgucuugguu

SEQ ID NO: 999 - RNA, 20 nt, Artificial Sequence
  synthesized
caccuccccgucuugucccc

SEQ ID NO: 1000 - RNA, 20 nt, Artificial Sequence
  synthesized
cccaccuccccgucuugucc

SEQ ID NO: 1001 - RNA, 20 nt, Artificial Sequence
  synthesized
ucccaccuccccgucuuguc

SEQ ID NO: 1002 - RNA, 20 nt, Artificial Sequence
  synthesized
cgugagugugacggggacaa

SEQ ID NO: 1003 - RNA, 20 nt, Artificial Sequence
  synthesized
cugcgugagugugacgggga

SEQ ID NO: 1004 - RNA, 20 nt, Artificial Sequence
  synthesized
ugcgugagugugacggggac

SEQ ID NO: 1005 - RNA, 20 nt, Artificial Sequence
  synthesized
accuccccgucuuguccccg

SEQ ID NO: 1006 - RNA, 20 nt, Artificial Sequence
  synthesized
ccccgucuuguccccgucac

SEQ ID NO: 1007 - RNA, 20 nt, Artificial Sequence
  synthesized
cccgucuuguccccgucaca

SEQ ID NO: 1008 - RNA, 20 nt, Artificial Sequence
  synthesized
ccuccccgucuuguccccgu

SEQ ID NO: 1009 - RNA, 20 nt, Artificial Sequence
  synthesized
cgucuuguccccgucacacu

SEQ ID NO: 1010 - RNA, 20 nt, Artificial Sequence
  synthesized
cuccccgucuuguccccguc

SEQ ID NO: 1011 - RNA, 20 nt, Artificial Sequence
  synthesized
cuuguccccgucacacucac

SEQ ID NO: 1012 - RNA, 20 nt, Artificial Sequence
  synthesized
gacggggacaagacggggag

SEQ ID NO: 1013 - RNA, 20 nt, Artificial Sequence
  synthesized
gucuuguccccgucacacuc

SEQ ID NO: 1014 - RNA, 20 nt, Artificial Sequence
  synthesized
gugagugugacggggacaag

SEQ ID NO: 1015 - RNA, 20 nt, Artificial Sequence
  synthesized
uccccgucuuguccccguca

SEQ ID NO: 1016 - RNA, 20 nt, Artificial Sequence
  synthesized
ugugacggggacaagacggg

SEQ ID NO: 1017 - RNA, 20 nt, Artificial Sequence
  synthesized
ucccccucccaccuccccgu

SEQ ID NO: 1018 - RNA, 20 nt, Artificial Sequence
  synthesized
acggcuucugcuuucacauu

SEQ ID NO: 1019 - RNA, 20 nt, Artificial Sequence
  synthesized
cacggcuucugcuuucacau

SEQ ID NO: 1020 - RNA, 20 nt, Artificial Sequence
  synthesized
cggcuucugcuuucacauug

SEQ ID NO: 1021 - RNA, 20 nt, Artificial Sequence
  synthesized
ggcuucugcuuucacauugu

SEQ ID NO: 1022 - RNA, 20 nt, Artificial Sequence
  synthesized
agucaccagagaacaaugug

SEQ ID NO: 1023 - RNA, 20 nt, Artificial Sequence
  synthesized
ucaccagagaacaaugugaa

SEQ ID NO: 1024 - RNA, 20 nt, Artificial Sequence
  synthesized
accagagaacaaugugaaag

SEQ ID NO: 1025 - RNA, 20 nt, Artificial Sequence
  synthesized
agaacaaugugaaagcagaa

SEQ ID NO: 1026 - RNA, 20 nt, Artificial Sequence
  synthesized
agagaacaaugugaaagcag

SEQ ID NO: 1027 - RNA, 20 nt, Artificial Sequence
  synthesized
caccagagaacaaugugaaa

SEQ ID NO: 1028 - RNA, 20 nt, Artificial Sequence
  synthesized
cagagaacaaugugaaagca

SEQ ID NO: 1029 - RNA, 20 nt, Artificial Sequence
  synthesized
cuucugcuuucacauuguuc

SEQ ID NO: 1030 - RNA, 20 nt, Artificial Sequence
  synthesized
cuuucacauuguucucuggu

SEQ ID NO: 1031 - RNA, 20 nt, Artificial Sequence
  synthesized
gaacaaugugaaagcagaag

SEQ ID NO: 1032 - RNA, 20 nt, Artificial Sequence
  synthesized
gagaacaaugugaaagcaga

SEQ ID NO: 1033 - RNA, 20 nt, Artificial Sequence
  synthesized
gcuucugcuuucacauuguu

SEQ ID NO: 1034 - RNA, 20 nt, Artificial Sequence
  synthesized
ugcuuucacauuguucucug

SEQ ID NO: 1035 - RNA, 20 nt, Artificial Sequence
  synthesized
uucugcuuucacauuguucu

SEQ ID NO: 1036 - RNA, 20 nt, Artificial Sequence
  synthesized
uuucacauuguucucuggug

SEQ ID NO: 1037 - RNA, 20 nt, Artificial Sequence
  synthesized
ggggagugggcacggcuucu

SEQ ID NO: 1038 - RNA, 20 nt, Artificial Sequence
  synthesized
aggaucugauccgggagcgc

SEQ ID NO: 1039 - RNA, 20 nt, Artificial Sequence
  synthesized
gaggaucugauccgggagcg

SEQ ID NO: 1040 - RNA, 20 nt, Artificial Sequence
  synthesized
accgcgccugaccuuugcag

SEQ ID NO: 1041 - RNA, 20 nt, Artificial Sequence
  synthesized
caccgcgccugaccuuugca

SEQ ID NO: 1042 - RNA, 20 nt, Artificial Sequence
  synthesized
caggacagggcauugauaau

SEQ ID NO: 1043 - RNA, 20 nt, Artificial Sequence
  synthesized
ccaggacagggcauugauaa

SEQ ID NO: 1044 - RNA, 20 nt, Artificial Sequence
  synthesized
gacaccgcgccugaccuuug

SEQ ID NO: 1045 - RNA, 20 nt, Artificial Sequence
  synthesized
gccaggacagggcauugaua

SEQ ID NO: 1046 - RNA, 20 nt, Artificial Sequence
  synthesized
aaaugguggaugaaaugguu

SEQ ID NO: 1047 - RNA, 20 nt, Artificial Sequence
  synthesized
acaaaugguggaugaaaugg

SEQ ID NO: 1048 - RNA, 20 nt, Artificial Sequence
  synthesized
agcccccguacauaccuuau

SEQ ID NO: 1049 - RNA, 20 nt, Artificial Sequence
  synthesized
gagagcccccguacauaccu

SEQ ID NO: 1050 - RNA, 20 nt, Artificial Sequence
  synthesized
gagcccccguacauaccuua

SEQ ID NO: 1051 - RNA, 20 nt, Artificial Sequence
  synthesized
ccucucuucuuccuguuggu

SEQ ID NO: 1052 - RNA, 20 nt, Artificial Sequence
  synthesized
guuaaaacuauaugcugggc

SEQ ID NO: 1053 - RNA, 20 nt, Artificial Sequence
  synthesized
uccucucuucuuccuguugg

SEQ ID NO: 1054 - RNA, 20 nt, Artificial Sequence
  synthesized
agacccuaaggagaagcaaa

SEQ ID NO: 1055 - RNA, 20 nt, Artificial Sequence
  synthesized
cagacccuaaggagaagcaa

SEQ ID NO: 1056 - RNA, 20 nt, Artificial Sequence
  synthesized
gacccuaaggagaagcaaaa

SEQ ID NO: 1057 - RNA, 20 nt, Artificial Sequence
  synthesized
uugcuucuccuuagggucug

SEQ ID NO: 1058 - RNA, 20 nt, Artificial Sequence
  synthesized
cucucuucuuucauaccuca

SEQ ID NO: 1059 - RNA, 20 nt, Artificial Sequence
  synthesized
ucucucuucuuucauaccuc

SEQ ID NO: 1060 - RNA, 20 nt, Artificial Sequence
  synthesized
ucucuucuuucauaccucaa

SEQ ID NO: 1061 - RNA, 20 nt, Artificial Sequence
  synthesized
ugacagaguaagaaucuguc

SEQ ID NO: 1062 - RNA, 20 nt, Artificial Sequence
  synthesized
aagggacaggaggucuggga

SEQ ID NO: 1063 - RNA, 20 nt, Artificial Sequence
  synthesized
aagggacgggaggucuggga

SEQ ID NO: 1064 - RNA, 20 nt, Artificial Sequence
  synthesized
aauaaauaagggacaggagg

SEQ ID NO: 1065 - RNA, 20 nt, Artificial Sequence
  synthesized
aauaaauaagggacgggagg

SEQ ID NO: 1066 - RNA, 20 nt, Artificial Sequence
  synthesized
aaucuucuuucccagaccuc

SEQ ID NO: 1067 - RNA, 20 nt, Artificial Sequence
  synthesized
accucccgucccuuauuuau

SEQ ID NO: 1068 - RNA, 20 nt, Artificial Sequence
  synthesized
accuccugucccuuauuuau

SEQ ID NO: 1069 - RNA, 20 nt, Artificial Sequence
  synthesized
agaccucccgucccuuauuu

SEQ ID NO: 1070 - RNA, 20 nt, Artificial Sequence
  synthesized
agaccuccugucccuuauuu

SEQ ID NO: 1071 - RNA, 20 nt, Artificial Sequence
  synthesized
aggaggucugggaaagaaga

SEQ ID NO: 1072 - RNA, 20 nt, Artificial Sequence
  synthesized
auaaauaagggacaggaggu

SEQ ID NO: 1073 - RNA, 20 nt, Artificial Sequence
  synthesized
auaaauaagggacgggaggu

SEQ ID NO: 1074 - RNA, 20 nt, Artificial Sequence
  synthesized
auaagggacaggaggucugg

SEQ ID NO: 1075 - RNA, 20 nt, Artificial Sequence
  synthesized
auaagggacgggaggucugg

SEQ ID NO: 1076 - RNA, 20 nt, Artificial Sequence
  synthesized
cagaccucccgucccuuauu

SEQ ID NO: 1077 - RNA, 20 nt, Artificial Sequence
  synthesized
cagaccuccugucccuuauu

SEQ ID NO: 1078 - RNA, 20 nt, Artificial Sequence
  synthesized
ccagaccucccgucccuuau

SEQ ID NO: 1079 - RNA, 20 nt, Artificial Sequence
  synthesized
ccagaccuccugucccuuau

SEQ ID NO: 1080 - RNA, 20 nt, Artificial Sequence
  synthesized
cccagaccucccgucccuua

SEQ ID NO: 1081 - RNA, 20 nt, Artificial Sequence
  synthesized
cccagaccuccugucccuua

SEQ ID NO: 1082 - RNA, 20 nt, Artificial Sequence
  synthesized
cccgucccuuauuuauuccu

SEQ ID NO: 1083 - RNA, 20 nt, Artificial Sequence
  synthesized
ccgucccuuauuuauuccuc

SEQ ID NO: 1084 - RNA, 20 nt, Artificial Sequence
  synthesized
ccucccgucccuuauuuauu

SEQ ID NO: 1085 - RNA, 20 nt, Artificial Sequence
  synthesized
ccuccugucccuuauuuauu

SEQ ID NO: 1086 - RNA, 20 nt, Artificial Sequence
  synthesized
ccugucccuuauuuauuccu

SEQ ID NO: 1087 - RNA, 20 nt, Artificial Sequence
  synthesized
cgucccuuauuuauuccucc

SEQ ID NO: 1088 - RNA, 20 nt, Artificial Sequence
  synthesized
cuccugucccuuauuuauuc

SEQ ID NO: 1089 - RNA, 20 nt, Artificial Sequence
  synthesized
cugucccuuauuuauuccuc

SEQ ID NO: 1090 - RNA, 20 nt, Artificial Sequence
  synthesized
cuucuuucccagaccucccg

SEQ ID NO: 1091 - RNA, 20 nt, Artificial Sequence
  synthesized
cuuucccagaccucccgucc

SEQ ID NO: 1092 - RNA, 20 nt, Artificial Sequence
  synthesized
gaauaaauaagggacaggag

SEQ ID NO: 1093 - RNA, 20 nt, Artificial Sequence
  synthesized
gaauaaauaagggacgggag

SEQ ID NO: 1094 - RNA, 20 nt, Artificial Sequence
  synthesized
gaccucccgucccuuauuua

SEQ ID NO: 1095 - RNA, 20 nt, Artificial Sequence
  synthesized
gaccuccugucccuuauuua

SEQ ID NO: 1096 - RNA, 20 nt, Artificial Sequence
  synthesized
gaggaauaaauaagggacag

SEQ ID NO: 1097 - RNA, 20 nt, Artificial Sequence
  synthesized
gaggaauaaauaagggacgg

SEQ ID NO: 1098 - RNA, 20 nt, Artificial Sequence
  synthesized
ggaauaaauaagggacagga

SEQ ID NO: 1099 - RNA, 20 nt, Artificial Sequence
  synthesized
ggaauaaauaagggacggga

SEQ ID NO: 1100 - RNA, 20 nt, Artificial Sequence
  synthesized
ggacgggaggucugggaaag

SEQ ID NO: 1101 - RNA, 20 nt, Artificial Sequence
  synthesized
gggacgggaggucugggaaa

SEQ ID NO: 1102 - RNA, 20 nt, Artificial Sequence
  synthesized
gggaggucugggaaagaaga

SEQ ID NO: 1103 - RNA, 20 nt, Artificial Sequence
  synthesized
uaagggacgggaggucuggg

SEQ ID NO: 1104 - RNA, 20 nt, Artificial Sequence
  synthesized
ucccagaccucccgucccuu

SEQ ID NO: 1105 - RNA, 20 nt, Artificial Sequence
  synthesized
ucccagaccuccugucccuu

SEQ ID NO: 1106 - RNA, 20 nt, Artificial Sequence
  synthesized
ucuucuuucccagaccuccc

SEQ ID NO: 1107 - RNA, 20 nt, Artificial Sequence
  synthesized
ucuuucccagaccucccguc

SEQ ID NO: 1108 - RNA, 20 nt, Artificial Sequence
  synthesized
ucuuucccagaccuccuguc

SEQ ID NO: 1109 - RNA, 20 nt, Artificial Sequence
  synthesized
ugucccuuauuuauuccucc

SEQ ID NO: 1110 - RNA, 20 nt, Artificial Sequence
  synthesized
uucccagaccucccgucccu

SEQ ID NO: 1111 - RNA, 20 nt, Artificial Sequence
  synthesized
uucccagaccuccugucccu

SEQ ID NO: 1112 - RNA, 20 nt, Artificial Sequence
  synthesized
uucuuucccagaccucccgu

SEQ ID NO: 1113 - RNA, 20 nt, Artificial Sequence
  synthesized
uuucccagaccucccguccc

SEQ ID NO: 1114 - RNA, 20 nt, Artificial Sequence
  synthesized
uuucccagaccuccuguccc

SEQ ID NO: 1115 - RNA, 20 nt, Artificial Sequence
  synthesized
acuccccacagacuccgaga

SEQ ID NO: 1116 - RNA, 20 nt, Artificial Sequence
  synthesized
acucccuacagacuccgaga

SEQ ID NO: 1117 - RNA, 20 nt, Artificial Sequence
  synthesized
agaugucgccacuccccaca

SEQ ID NO: 1118 - RNA, 20 nt, Artificial Sequence
  synthesized
agaugucgccacucccuaca

SEQ ID NO: 1119 - RNA, 20 nt, Artificial Sequence
  synthesized
agggaguggcgacaucugga

SEQ ID NO: 1120 - RNA, 20 nt, Artificial Sequence
  synthesized
agucuguagggaguggcgac

SEQ ID NO: 1121 - RNA, 20 nt, Artificial Sequence
  synthesized
agucuguggggaguggcgac

SEQ ID NO: 1122 - RNA, 20 nt, Artificial Sequence
  synthesized
augucgccacuccccacaga

SEQ ID NO: 1123 - RNA, 20 nt, Artificial Sequence
  synthesized
augucgccacucccuacaga

SEQ ID NO: 1124 - RNA, 20 nt, Artificial Sequence
  synthesized
cacagacuccgagacaccaa

SEQ ID NO: 1125 - RNA, 20 nt, Artificial Sequence
  synthesized
cacuccccacagacuccgag

SEQ ID NO: 1126 - RNA, 20 nt, Artificial Sequence
  synthesized
cacucccuacagacuccgag

SEQ ID NO: 1127 - RNA, 20 nt, Artificial Sequence
  synthesized
ccacuccccacagacuccga

SEQ ID NO: 1128 - RNA, 20 nt, Artificial Sequence
  synthesized
ccacucccuacagacuccga

SEQ ID NO: 1129 - RNA, 20 nt, Artificial Sequence
  synthesized
ccagaugucgccacucccca

SEQ ID NO: 1130 - RNA, 20 nt, Artificial Sequence
  synthesized
ccagaugucgccacucccua

SEQ ID NO: 1131 - RNA, 20 nt, Artificial Sequence
  synthesized
cccacagacuccgagacacc

SEQ ID NO: 1132 - RNA, 20 nt, Artificial Sequence
  synthesized
ccccacagacuccgagacac

SEQ ID NO: 1133 - RNA, 20 nt, Artificial Sequence
  synthesized
cccuacagacuccgagacac

SEQ ID NO: 1134 - RNA, 20 nt, Artificial Sequence
  synthesized
ccuacagacuccgagacacc

SEQ ID NO: 1135 - RNA, 20 nt, Artificial Sequence
  synthesized
cgccacuccccacagacucc

SEQ ID NO: 1136 - RNA, 20 nt, Artificial Sequence
  synthesized
cgccacucccuacagacucc

SEQ ID NO: 1137 - RNA, 20 nt, Artificial Sequence
  synthesized
cggagucuguagggaguggc

SEQ ID NO: 1138 - RNA, 20 nt, Artificial Sequence
  synthesized
cggagucuguggggaguggc

SEQ ID NO: 1139 - RNA, 20 nt, Artificial Sequence
  synthesized
cuccccacagacuccgagac

SEQ ID NO: 1140 - RNA, 20 nt, Artificial Sequence
  synthesized
cucccuacagacuccgagac

SEQ ID NO: 1141 - RNA, 20 nt, Artificial Sequence
  synthesized
cucggagucuguagggagug

SEQ ID NO: 1142 - RNA, 20 nt, Artificial Sequence
  synthesized
cucggagucuguggggagug

SEQ ID NO: 1143 - RNA, 20 nt, Artificial Sequence
  synthesized
gagucuguagggaguggcga

SEQ ID NO: 1144 - RNA, 20 nt, Artificial Sequence
  synthesized
gagucuguggggaguggcga

SEQ ID NO: 1145 - RNA, 20 nt, Artificial Sequence
  synthesized
gaugucgccacuccccacag

SEQ ID NO: 1146 - RNA, 20 nt, Artificial Sequence
  synthesized
gaugucgccacucccuacag

SEQ ID NO: 1147 - RNA, 20 nt, Artificial Sequence
  synthesized
ggagucuguagggaguggcg

SEQ ID NO: 1148 - RNA, 20 nt, Artificial Sequence
  synthesized
ggagucuguggggaguggcg

SEQ ID NO: 1149 - RNA, 20 nt, Artificial Sequence
  synthesized
ggggaguggcgacaucugga

SEQ ID NO: 1150 - RNA, 20 nt, Artificial Sequence
  synthesized
ggugucucggagucuguagg

SEQ ID NO: 1151 - RNA, 20 nt, Artificial Sequence
  synthesized
ggugucucggagucuguggg

SEQ ID NO: 1152 - RNA, 20 nt, Artificial Sequence
  synthesized
guagggaguggcgacaucug

SEQ ID NO: 1153 - RNA, 20 nt, Artificial Sequence
  synthesized
gucgccacuccccacagacu

SEQ ID NO: 1154 - RNA, 20 nt, Artificial Sequence
  synthesized
gucgccacucccuacagacu

SEQ ID NO: 1155 - RNA, 20 nt, Artificial Sequence
  synthesized
gucuguagggaguggcgaca

SEQ ID NO: 1156 - RNA, 20 nt, Artificial Sequence
  synthesized
gucuguggggaguggcgaca

SEQ ID NO: 1157 - RNA, 20 nt, Artificial Sequence
  synthesized
guggggaguggcgacaucug

SEQ ID NO: 1158 - RNA, 20 nt, Artificial Sequence
  synthesized
uacagacuccgagacaccaa

SEQ ID NO: 1159 - RNA, 20 nt, Artificial Sequence
  synthesized
uagggaguggcgacaucugg

SEQ ID NO: 1160 - RNA, 20 nt, Artificial Sequence
  synthesized
uccagaugucgccacucccc

SEQ ID NO: 1161 - RNA, 20 nt, Artificial Sequence
  synthesized
uccagaugucgccacucccu

SEQ ID NO: 1162 - RNA, 20 nt, Artificial Sequence
  synthesized
uggggaguggcgacaucugg

SEQ ID NO: 1163 - RNA, 20 nt, Artificial Sequence
  synthesized
ugucgccacuccccacagac

SEQ ID NO: 1164 - RNA, 20 nt, Artificial Sequence
  synthesized
ugucgccacucccuacagac

SEQ ID NO: 1165 - RNA, 20 nt, Artificial Sequence
  synthesized
ugucucggagucuguaggga

SEQ ID NO: 1166 - RNA, 20 nt, Artificial Sequence
  synthesized
ugucucggagucugugggga

SEQ ID NO: 1167 - RNA, 20 nt, Artificial Sequence
  synthesized
acuacagacgcccgccacca

SEQ ID NO: 1168 - RNA, 20 nt, Artificial Sequence
  synthesized
agacgcccgccaccacaccc

SEQ ID NO: 1169 - RNA, 20 nt, Artificial Sequence
  synthesized
agccgggugugguggcgggc

SEQ ID NO: 1170 - RNA, 20 nt, Artificial Sequence
  synthesized
aguagcugggacuacagacg

SEQ ID NO: 1171 - RNA, 20 nt, Artificial Sequence
  synthesized
aguagcugggacuacaggcg

SEQ ID NO: 1172 - RNA, 20 nt, Artificial Sequence
  synthesized
cgggcgccuguagucccagc

SEQ ID NO: 1173 - RNA, 20 nt, Artificial Sequence
  synthesized
cgggcgucuguagucccagc

SEQ ID NO: 1174 - RNA, 20 nt, Artificial Sequence
  synthesized
gcgggcgccuguagucccag

SEQ ID NO: 1175 - RNA, 20 nt, Artificial Sequence
  synthesized
gggcgccuguagucccagcu

SEQ ID NO: 1176 - RNA, 20 nt, Artificial Sequence
  synthesized
gguggcgggcgucuguaguc

SEQ ID NO: 1177 - RNA, 20 nt, Artificial Sequence
  synthesized
ggugugguggcgggcgucug

SEQ ID NO: 1178 - RNA, 20 nt, Artificial Sequence
  synthesized
guagcugggacuacaggcgc

SEQ ID NO: 1179 - RNA, 20 nt, Artificial Sequence
  synthesized
aggugagagaaucacuagag

SEQ ID NO: 1180 - RNA, 20 nt, Artificial Sequence
  synthesized
cacuugggguggcugaggug

SEQ ID NO: 1181 - RNA, 20 nt, Artificial Sequence
  synthesized
cucucaccucagccacccca

SEQ ID NO: 1182 - RNA, 20 nt, Artificial Sequence
  synthesized
ggcugaggugagagaaucac

SEQ ID NO: 1183 - RNA, 20 nt, Artificial Sequence
  synthesized
gggguggcugaggugagaga

SEQ ID NO: 1184 - RNA, 20 nt, Artificial Sequence
  synthesized
uaggcucuagugauucucuc

SEQ ID NO: 1185 - RNA, 20 nt, Artificial Sequence
  synthesized
ucuagugauucucucaccuc

SEQ ID NO: 1186 - RNA, 20 nt, Artificial Sequence
  synthesized
ugauucucucaccucagcca

SEQ ID NO: 1187 - RNA, 20 nt, Artificial Sequence
  synthesized
aagucucgggccucucaggc

SEQ ID NO: 1188 - RNA, 20 nt, Artificial Sequence
  synthesized
aagucucgggccucucgggc

SEQ ID NO: 1189 - RNA, 20 nt, Artificial Sequence
  synthesized
agcagcccgagaggcccgag

SEQ ID NO: 1190 - RNA, 20 nt, Artificial Sequence
  synthesized
agcagccugagaggcccgag

SEQ ID NO: 1191 - RNA, 20 nt, Artificial Sequence
  synthesized
agcccgagaggcccgagacu

SEQ ID NO: 1192 - RNA, 20 nt, Artificial Sequence
  synthesized
agccugagaggcccgagacu

SEQ ID NO: 1193 - RNA, 20 nt, Artificial Sequence
  synthesized
aggcugcuggaaaagaccag

SEQ ID NO: 1194 - RNA, 20 nt, Artificial Sequence
  synthesized
agucucgggccucucaggcu

SEQ ID NO: 1195 - RNA, 20 nt, Artificial Sequence
  synthesized
agucucgggccucucgggcu

SEQ ID NO: 1196 - RNA, 20 nt, Artificial Sequence
  synthesized
cagcagcccgagaggcccga

SEQ ID NO: 1197 - RNA, 20 nt, Artificial Sequence
  synthesized
cagcagccugagaggcccga

SEQ ID NO: 1198 - RNA, 20 nt, Artificial Sequence
  synthesized
cagcccgagaggcccgagac

SEQ ID NO: 1199 - RNA, 20 nt, Artificial Sequence
  synthesized
cagccugagaggcccgagac

SEQ ID NO: 1200 - RNA, 20 nt, Artificial Sequence
  synthesized
caggcugcuggaaaagacca

SEQ ID NO: 1201 - RNA, 20 nt, Artificial Sequence
  synthesized
ccagcagcccgagaggcccg

SEQ ID NO: 1202 - RNA, 20 nt, Artificial Sequence
  synthesized
ccagcagccugagaggcccg

SEQ ID NO: 1203 - RNA, 20 nt, Artificial Sequence
  synthesized
cccgagaggcccgagacuuc

SEQ ID NO: 1204 - RNA, 20 nt, Artificial Sequence
  synthesized
ccgagaggcccgagacuucc

SEQ ID NO: 1205 - RNA, 20 nt, Artificial Sequence
  synthesized
ccucucaggcugcuggaaaa

SEQ ID NO: 1206 - RNA, 20 nt, Artificial Sequence
  synthesized
ccucucgggcugcuggaaaa

SEQ ID NO: 1207 - RNA, 20 nt, Artificial Sequence
  synthesized
ccugagaggcccgagacuuc

SEQ ID NO: 1208 - RNA, 20 nt, Artificial Sequence
  synthesized
cgagaggcccgagacuuccc

SEQ ID NO: 1209 - RNA, 20 nt, Artificial Sequence
  synthesized
cgggccucucgggcugcugg

SEQ ID NO: 1210 - RNA, 20 nt, Artificial Sequence
  synthesized
cgggcugcuggaaaagacca

SEQ ID NO: 1211 - RNA, 20 nt, Artificial Sequence
  synthesized
cucaggcugcuggaaaagac

SEQ ID NO: 1212 - RNA, 20 nt, Artificial Sequence
  synthesized
cucgggccucucaggcugcu

SEQ ID NO: 1213 - RNA, 20 nt, Artificial Sequence
  synthesized
cucgggccucucgggcugcu

SEQ ID NO: 1214 - RNA, 20 nt, Artificial Sequence
  synthesized
cucgggcugcuggaaaagac

SEQ ID NO: 1215 - RNA, 20 nt, Artificial Sequence
  synthesized
cucucaggcugcuggaaaag

SEQ ID NO: 1216 - RNA, 20 nt, Artificial Sequence
  synthesized
cucucgggcugcuggaaaag

SEQ ID NO: 1217 - RNA, 20 nt, Artificial Sequence
  synthesized
cugagaggcccgagacuucc

SEQ ID NO: 1218 - RNA, 20 nt, Artificial Sequence
  synthesized
gaagucucgggccucucagg

SEQ ID NO: 1219 - RNA, 20 nt, Artificial Sequence
  synthesized
gaagucucgggccucucggg

SEQ ID NO: 1220 - RNA, 20 nt, Artificial Sequence
  synthesized
gcagcccgagaggcccgaga

SEQ ID NO: 1221 - RNA, 20 nt, Artificial Sequence
  synthesized
gcagccugagaggcccgaga

SEQ ID NO: 1222 - RNA, 20 nt, Artificial Sequence
  synthesized
gcccgagaggcccgagacuu

SEQ ID NO: 1223 - RNA, 20 nt, Artificial Sequence
  synthesized
gccucucaggcugcuggaaa

SEQ ID NO: 1224 - RNA, 20 nt, Artificial Sequence
  synthesized
gccucucgggcugcuggaaa

SEQ ID NO: 1225 - RNA, 20 nt, Artificial Sequence
  synthesized
gccugagaggcccgagacuu

SEQ ID NO: 1226 - RNA, 20 nt, Artificial Sequence
  synthesized
ggaagucucgggccucucag

SEQ ID NO: 1227 - RNA, 20 nt, Artificial Sequence
  synthesized
ggaagucucgggccucucgg

SEQ ID NO: 1228 - RNA, 20 nt, Artificial Sequence
  synthesized
ggccucucaggcugcuggaa

SEQ ID NO: 1229 - RNA, 20 nt, Artificial Sequence
  synthesized
ggccucucgggcugcuggaa

SEQ ID NO: 1230 - RNA, 20 nt, Artificial Sequence
  synthesized
gggaagucucgggccucuca

SEQ ID NO: 1231 - RNA, 20 nt, Artificial Sequence
  synthesized
gggaagucucgggccucucg

SEQ ID NO: 1232 - RNA, 20 nt, Artificial Sequence
  synthesized
gggccucucgggcugcugga

SEQ ID NO: 1233 - RNA, 20 nt, Artificial Sequence
  synthesized
gggcugcuggaaaagaccag

SEQ ID NO: 1234 - RNA, 20 nt, Artificial Sequence
  synthesized
gucucgggccucucaggcug

SEQ ID NO: 1235 - RNA, 20 nt, Artificial Sequence
  synthesized
gucucgggccucucgggcug

SEQ ID NO: 1236 - RNA, 20 nt, Artificial Sequence
  synthesized
ucaggcugcuggaaaagacc

SEQ ID NO: 1237 - RNA, 20 nt, Artificial Sequence
  synthesized
uccagcagcccgagaggccc

SEQ ID NO: 1238 - RNA, 20 nt, Artificial Sequence
  synthesized
uccagcagccugagaggccc

SEQ ID NO: 1239 - RNA, 20 nt, Artificial Sequence
  synthesized
ucgggccucucaggcugcug

SEQ ID NO: 1240 - RNA, 20 nt, Artificial Sequence
  synthesized
ucgggccucucgggcugcug

SEQ ID NO: 1241 - RNA, 20 nt, Artificial Sequence
  synthesized
ucgggcugcuggaaaagacc

SEQ ID NO: 1242 - RNA, 20 nt, Artificial Sequence
  synthesized
ucucaggcugcuggaaaaga

SEQ ID NO: 1243 - RNA, 20 nt, Artificial Sequence
  synthesized
ucucgggccucucaggcugc

SEQ ID NO: 1244 - RNA, 20 nt, Artificial Sequence
  synthesized
ucucgggccucucgggcugc

SEQ ID NO: 1245 - RNA, 20 nt, Artificial Sequence
  synthesized
ucucgggcugcuggaaaaga

SEQ ID NO: 1246 - RNA, 20 nt, Artificial Sequence
  synthesized
ugagaggcccgagacuuccc

SEQ ID NO: 1247 - RNA, 20 nt, Artificial Sequence
  synthesized
uuccagcagcccgagaggcc

SEQ ID NO: 1248 - RNA, 20 nt, Artificial Sequence
  synthesized
uuccagcagccugagaggcc

SEQ ID NO: 1249 - RNA, 20 nt, Artificial Sequence
  synthesized
uuuccagcagcccgagaggc

SEQ ID NO: 1250 - RNA, 20 nt, Artificial Sequence
  synthesized
uuuccagcagccugagaggc

SEQ ID NO: 1251 - RNA, 20 nt, Artificial Sequence
  synthesized
aauaaugccggaacauugcc

SEQ ID NO: 1252 - RNA, 20 nt, Artificial Sequence
  synthesized
aaugccggaacauugccgag

SEQ ID NO: 1253 - RNA, 20 nt, Artificial Sequence
  synthesized
aaugcuggaacauugccgag

SEQ ID NO: 1254 - RNA, 20 nt, Artificial Sequence
  synthesized
aauguuccggcauuauuuca

SEQ ID NO: 1255 - RNA, 20 nt, Artificial Sequence
  synthesized
acgucucggcaauguuccag

SEQ ID NO: 1256 - RNA, 20 nt, Artificial Sequence
  synthesized
acgucucggcaauguuccgg

SEQ ID NO: 1257 - RNA, 20 nt, Artificial Sequence
  synthesized
agauuugaaauaaugccgga

SEQ ID NO: 1258 - RNA, 20 nt, Artificial Sequence
  synthesized
augccggaacauugccgaga

SEQ ID NO: 1259 - RNA, 20 nt, Artificial Sequence
  synthesized
augcuggaacauugccgaga

SEQ ID NO: 1260 - RNA, 20 nt, Artificial Sequence
  synthesized
auguuccggcauuauuucaa

SEQ ID NO: 1261 - RNA, 20 nt, Artificial Sequence
  synthesized
auuugaaauaaugccggaac

SEQ ID NO: 1262 - RNA, 20 nt, Artificial Sequence
  synthesized
caauguuccggcauuauuuc

SEQ ID NO: 1263 - RNA, 20 nt, Artificial Sequence
  synthesized
ccggaacauugccgagacgu

SEQ ID NO: 1264 - RNA, 20 nt, Artificial Sequence
  synthesized
ccggcauuauuucaaaucua

SEQ ID NO: 1265 - RNA, 20 nt, Artificial Sequence
  synthesized
cggaacauugccgagacgua

SEQ ID NO: 1266 - RNA, 20 nt, Artificial Sequence
  synthesized
cggcaauguuccagcauuau

SEQ ID NO: 1267 - RNA, 20 nt, Artificial Sequence
  synthesized
cggcaauguuccggcauuau

SEQ ID NO: 1268 - RNA, 20 nt, Artificial Sequence
  synthesized
cgucucggcaauguuccagc

SEQ ID NO: 1269 - RNA, 20 nt, Artificial Sequence
  synthesized
cgucucggcaauguuccggc

SEQ ID NO: 1270 - RNA, 20 nt, Artificial Sequence
  synthesized
cucggcaauguuccagcauu

SEQ ID NO: 1271 - RNA, 20 nt, Artificial Sequence
  synthesized
cucggcaauguuccggcauu

SEQ ID NO: 1272 - RNA, 20 nt, Artificial Sequence
  synthesized
cuggaacauugccgagacgu

SEQ ID NO: 1273 - RNA, 20 nt, Artificial Sequence
  synthesized
gaaauaaugccggaacauug

SEQ ID NO: 1274 - RNA, 20 nt, Artificial Sequence
  synthesized
gaaauaaugcuggaacauug

SEQ ID NO: 1275 - RNA, 20 nt, Artificial Sequence
  synthesized
gauuugaaauaaugccggaa

SEQ ID NO: 1276 - RNA, 20 nt, Artificial Sequence
  synthesized
gcaauguuccggcauuauuu

SEQ ID NO: 1277 - RNA, 20 nt, Artificial Sequence
  synthesized
gccggaacauugccgagacg

SEQ ID NO: 1278 - RNA, 20 nt, Artificial Sequence
  synthesized
gcuggaacauugccgagacg

SEQ ID NO: 1279 - RNA, 20 nt, Artificial Sequence
  synthesized
gucucggcaauguuccagca

SEQ ID NO: 1280 - RNA, 20 nt, Artificial Sequence
  synthesized
gucucggcaauguuccggca

SEQ ID NO: 1281 - RNA, 20 nt, Artificial Sequence
  synthesized
guuccggcauuauuucaaau

SEQ ID NO: 1282 - RNA, 20 nt, Artificial Sequence
  synthesized
uaaugccggaacauugccga

SEQ ID NO: 1283 - RNA, 20 nt, Artificial Sequence
  synthesized
uaaugcuggaacauugccga

SEQ ID NO: 1284 - RNA, 20 nt, Artificial Sequence
  synthesized
uacgucucggcaauguucca

SEQ ID NO: 1285 - RNA, 20 nt, Artificial Sequence
  synthesized
uacgucucggcaauguuccg

SEQ ID NO: 1286 - RNA, 20 nt, Artificial Sequence
  synthesized
uagauuugaaauaaugccgg

SEQ ID NO: 1287 - RNA, 20 nt, Artificial Sequence
  synthesized
ucggcaauguuccagcauua

SEQ ID NO: 1288 - RNA, 20 nt, Artificial Sequence
  synthesized
ucggcaauguuccggcauua

SEQ ID NO: 1289 - RNA, 20 nt, Artificial Sequence
  synthesized
ucucggcaauguuccggcau

SEQ ID NO: 1290 - RNA, 20 nt, Artificial Sequence
  synthesized
ugaaauaaugccggaacauu

SEQ ID NO: 1291 - RNA, 20 nt, Artificial Sequence
  synthesized
ugccggaacauugccgagac

SEQ ID NO: 1292 - RNA, 20 nt, Artificial Sequence
  synthesized
ugcuggaacauugccgagac

SEQ ID NO: 1293 - RNA, 20 nt, Artificial Sequence
  synthesized
uggaacauugccgagacgua

SEQ ID NO: 1294 - RNA, 20 nt, Artificial Sequence
  synthesized
uuccggcauuauuucaaauc

SEQ ID NO: 1295 - RNA, 20 nt, Artificial Sequence
  synthesized
uugaaauaaugccggaacau

SEQ ID NO: 1296 - RNA, 20 nt, Artificial Sequence
  synthesized
uuugaaauaaugccggaaca

SEQ ID NO: 1297 - RNA, 20 nt, Artificial Sequence
  synthesized
aacaacugaccucugggaac

SEQ ID NO: 1298 - RNA, 20 nt, Artificial Sequence
  synthesized
acaacugaccucugggaacc

SEQ ID NO: 1299 - RNA, 20 nt, Artificial Sequence
  synthesized
acuagcugagaacaacugac

SEQ ID NO: 1300 - RNA, 20 nt, Artificial Sequence
  synthesized
acuagcugagaucaacugac

SEQ ID NO: 1301 - RNA, 20 nt, Artificial Sequence
  synthesized
agaacaacugaccucuggga

SEQ ID NO: 1302 - RNA, 20 nt, Artificial Sequence
  synthesized
agaggucaguugaucucagc

SEQ ID NO: 1303 - RNA, 20 nt, Artificial Sequence
  synthesized
agaggucaguuguucucagc

SEQ ID NO: 1304 - RNA, 20 nt, Artificial Sequence
  synthesized
agaucaacugaccucuggga

SEQ ID NO: 1305 - RNA, 20 nt, Artificial Sequence
  synthesized
aggucaguugaucucagcua

SEQ ID NO: 1306 - RNA, 20 nt, Artificial Sequence
  synthesized
aggucaguuguucucagcua

SEQ ID NO: 1307 - RNA, 20 nt, Artificial Sequence
  synthesized
aucaacugaccucugggaac

SEQ ID NO: 1308 - RNA, 20 nt, Artificial Sequence
  synthesized
auuacuagcugagaucaacu

SEQ ID NO: 1309 - RNA, 20 nt, Artificial Sequence
  synthesized
caauuacuagcugagaucaa

SEQ ID NO: 1310 - RNA, 20 nt, Artificial Sequence
  synthesized
cagaggucaguugaucucag

SEQ ID NO: 1311 - RNA, 20 nt, Artificial Sequence
  synthesized
cagaggucaguuguucucag

SEQ ID NO: 1312 - RNA, 20 nt, Artificial Sequence
  synthesized
caguugaucucagcuaguaa

SEQ ID NO: 1313 - RNA, 20 nt, Artificial Sequence
  synthesized
cccagaggucaguugaucuc

SEQ ID NO: 1314 - RNA, 20 nt, Artificial Sequence
  synthesized
cccagaggucaguuguucuc

SEQ ID NO: 1315 - RNA, 20 nt, Artificial Sequence
  synthesized
cuagcugagaacaacugacc

SEQ ID NO: 1316 - RNA, 20 nt, Artificial Sequence
  synthesized
cuagcugagaucaacugacc

SEQ ID NO: 1317 - RNA, 20 nt, Artificial Sequence
  synthesized
gaacaacugaccucugggaa

SEQ ID NO: 1318 - RNA, 20 nt, Artificial Sequence
  synthesized
gagaacaacugaccucuggg

SEQ ID NO: 1319 - RNA, 20 nt, Artificial Sequence
  synthesized
gagaucaacugaccucuggg

SEQ ID NO: 1320 - RNA, 20 nt, Artificial Sequence
  synthesized
gaggucaguugaucucagcu

SEQ ID NO: 1321 - RNA, 20 nt, Artificial Sequence
  synthesized
gaggucaguuguucucagcu

SEQ ID NO: 1322 - RNA, 20 nt, Artificial Sequence
  synthesized
gaucaacugaccucugggaa

SEQ ID NO: 1323 - RNA, 20 nt, Artificial Sequence
  synthesized
ggucaguugaucucagcuag

SEQ ID NO: 1324 - RNA, 20 nt, Artificial Sequence
  synthesized
gguucccagaggucaguuga

SEQ ID NO: 1325 - RNA, 20 nt, Artificial Sequence
  synthesized
gguucccagaggucaguugu

SEQ ID NO: 1326 - RNA, 20 nt, Artificial Sequence
  synthesized
gucaauuacuagcugagaac

SEQ ID NO: 1327 - RNA, 20 nt, Artificial Sequence
  synthesized
gucaauuacuagcugagauc

SEQ ID NO: 1328 - RNA, 20 nt, Artificial Sequence
  synthesized
gucaguugaucucagcuagu

SEQ ID NO: 1329 - RNA, 20 nt, Artificial Sequence
  synthesized
guucccagaggucaguugau

SEQ ID NO: 1330 - RNA, 20 nt, Artificial Sequence
  synthesized
guucccagaggucaguuguu

SEQ ID NO: 1331 - RNA, 20 nt, Artificial Sequence
  synthesized
guugaucucagcuaguaauu

SEQ ID NO: 1332 - RNA, 20 nt, Artificial Sequence
  synthesized
uacuagcugagaacaacuga

SEQ ID NO: 1333 - RNA, 20 nt, Artificial Sequence
  synthesized
uacuagcugagaucaacuga

SEQ ID NO: 1334 - RNA, 20 nt, Artificial Sequence
  synthesized
uagcugagaacaacugaccu

SEQ ID NO: 1335 - RNA, 20 nt, Artificial Sequence
  synthesized
uagcugagaucaacugaccu

SEQ ID NO: 1336 - RNA, 20 nt, Artificial Sequence
  synthesized
ucaacugaccucugggaacc

SEQ ID NO: 1337 - RNA, 20 nt, Artificial Sequence
  synthesized
ucccagaggucaguugaucu

SEQ ID NO: 1338 - RNA, 20 nt, Artificial Sequence
  synthesized
ucccagaggucaguuguucu

SEQ ID NO: 1339 - RNA, 20 nt, Artificial Sequence
  synthesized
ugagaacaacugaccucugg

SEQ ID NO: 1340 - RNA, 20 nt, Artificial Sequence
  synthesized
ugagaucaacugaccucugg

SEQ ID NO: 1341 - RNA, 20 nt, Artificial Sequence
  synthesized
ugucaauuacuagcugagau

SEQ ID NO: 1342 - RNA, 20 nt, Artificial Sequence
  synthesized
uuacuagcugagaacaacug

SEQ ID NO: 1343 - RNA, 20 nt, Artificial Sequence
  synthesized
uuacuagcugagaucaacug

SEQ ID NO: 1344 - RNA, 20 nt, Artificial Sequence
  synthesized
uucccagaggucaguugauc

SEQ ID NO: 1345 - RNA, 20 nt, Artificial Sequence
  synthesized
uugaucucagcuaguaauug

SEQ ID NO: 1346 - RNA, 20 nt, Artificial Sequence
  synthesized
uuguucucagcuaguaauug

SEQ ID NO: 1347 - RNA, 20 nt, Artificial Sequence
  synthesized
aaaaaaucuuggugucucgg

SEQ ID NO: 1348 - RNA, 20 nt, Artificial Sequence
  synthesized
aaaaaucuuggugucucgga

SEQ ID NO: 1349 - RNA, 20 nt, Artificial Sequence
  synthesized
agaaaaucuuggugucucgg

SEQ ID NO: 1350 - RNA, 20 nt, Artificial Sequence
  synthesized
auguucagaaaaucuuggug

SEQ ID NO: 1351 - RNA, 20 nt, Artificial Sequence
  synthesized
caaaaaaucuuggugucucg

SEQ ID NO: 1352 - RNA, 20 nt, Artificial Sequence
  synthesized
cagaaaaucuuggugucucg

SEQ ID NO: 1353 - RNA, 20 nt, Artificial Sequence
  synthesized
gaaaaucuuggugucucgga

SEQ ID NO: 1354 - RNA, 20 nt, Artificial Sequence
  synthesized
gaauguucagaaaaucuugg

SEQ ID NO: 1355 - RNA, 20 nt, Artificial Sequence
  synthesized
ggaauguucagaaaaucuug

SEQ ID NO: 1356 - RNA, 20 nt, Artificial Sequence
  synthesized
guucaaaaaaucuugguguc

SEQ ID NO: 1357 - RNA, 20 nt, Artificial Sequence
  synthesized
guucagaaaaucuugguguc

SEQ ID NO: 1358 - RNA, 20 nt, Artificial Sequence
  synthesized
uguucagaaaaucuuggugu

SEQ ID NO: 1359 - RNA, 20 nt, Artificial Sequence
  synthesized
aaggaaccggcucagcccug

SEQ ID NO: 1360 - RNA, 20 nt, Artificial Sequence
  synthesized
aaggugggaaggaaccggcu

SEQ ID NO: 1361 - RNA, 20 nt, Artificial Sequence
  synthesized
acuggcucagcccugcccac

SEQ ID NO: 1362 - RNA, 20 nt, Artificial Sequence
  synthesized
agccaguuccuucccaccuu

SEQ ID NO: 1363 - RNA, 20 nt, Artificial Sequence
  synthesized
agccgguuccuucccaccuu

SEQ ID NO: 1364 - RNA, 20 nt, Artificial Sequence
  synthesized
aggaaccggcucagcccugc

SEQ ID NO: 1365 - RNA, 20 nt, Artificial Sequence
  synthesized
aggaacuggcucagcccugc

SEQ ID NO: 1366 - RNA, 20 nt, Artificial Sequence
  synthesized
agggcugagccaguuccuuc

SEQ ID NO: 1367 - RNA, 20 nt, Artificial Sequence
  synthesized
agggcugagccgguuccuuc

SEQ ID NO: 1368 - RNA, 20 nt, Artificial Sequence
  synthesized
aggugggaaggaaccggcuc

SEQ ID NO: 1369 - RNA, 20 nt, Artificial Sequence
  synthesized
agugaaggugggaaggaacc

SEQ ID NO: 1370 - RNA, 20 nt, Artificial Sequence
  synthesized
agugaaggugggaaggaacu

SEQ ID NO: 1371 - RNA, 20 nt, Artificial Sequence
  synthesized
agugggcagggcugagccag

SEQ ID NO: 1372 - RNA, 20 nt, Artificial Sequence
  synthesized
agugggcagggcugagccgg

SEQ ID NO: 1373 - RNA, 20 nt, Artificial Sequence
  synthesized
aguuccuucccaccuucacu

SEQ ID NO: 1374 - RNA, 20 nt, Artificial Sequence
  synthesized
cagggcugagccaguuccuu

SEQ ID NO: 1375 - RNA, 20 nt, Artificial Sequence
  synthesized
cagggcugagccgguuccuu

SEQ ID NO: 1376 - RNA, 20 nt, Artificial Sequence
  synthesized
cggcucagcccugcccacuc

SEQ ID NO: 1377 - RNA, 20 nt, Artificial Sequence
  synthesized
cgguuccuucccaccuucac

SEQ ID NO: 1378 - RNA, 20 nt, Artificial Sequence
  synthesized
cugagccgguuccuucccac

SEQ ID NO: 1379 - RNA, 20 nt, Artificial Sequence
  synthesized
cugagugaaggugggaagga

SEQ ID NO: 1380 - RNA, 20 nt, Artificial Sequence
  synthesized
gaaccggcucagcccugccc

SEQ ID NO: 1381 - RNA, 20 nt, Artificial Sequence
  synthesized
gaaggaacuggcucagcccu

SEQ ID NO: 1382 - RNA, 20 nt, Artificial Sequence
  synthesized
gaaggugggaaggaaccggc

SEQ ID NO: 1383 - RNA, 20 nt, Artificial Sequence
  synthesized
gagccaguuccuucccaccu

SEQ ID NO: 1384 - RNA, 20 nt, Artificial Sequence
  synthesized
gagccgguuccuucccaccu

SEQ ID NO: 1385 - RNA, 20 nt, Artificial Sequence
  synthesized
gagugggcagggcugagccg

SEQ ID NO: 1386 - RNA, 20 nt, Artificial Sequence
  synthesized
gccgguuccuucccaccuuc

SEQ ID NO: 1387 - RNA, 20 nt, Artificial Sequence
  synthesized
gcugagccgguuccuuccca

SEQ ID NO: 1388 - RNA, 20 nt, Artificial Sequence
  synthesized
ggaaccggcucagcccugcc

SEQ ID NO: 1389 - RNA, 20 nt, Artificial Sequence
  synthesized
ggaacuggcucagcccugcc

SEQ ID NO: 1390 - RNA, 20 nt, Artificial Sequence
  synthesized
ggaaggaaccggcucagccc

SEQ ID NO: 1391 - RNA, 20 nt, Artificial Sequence
  synthesized
ggaaggaacuggcucagccc

SEQ ID NO: 1392 - RNA, 20 nt, Artificial Sequence
  synthesized
ggcagggcugagccaguucc

SEQ ID NO: 1393 - RNA, 20 nt, Artificial Sequence
  synthesized
ggcagggcugagccgguucc

SEQ ID NO: 1394 - RNA, 20 nt, Artificial Sequence
  synthesized
ggcugagccgguuccuuccc

SEQ ID NO: 1395 - RNA, 20 nt, Artificial Sequence
  synthesized
gggaaggaaccggcucagcc

SEQ ID NO: 1396 - RNA, 20 nt, Artificial Sequence
  synthesized
gggaaggaacuggcucagcc

SEQ ID NO: 1397 - RNA, 20 nt, Artificial Sequence
  synthesized
gggcagggcugagccaguuc

SEQ ID NO: 1398 - RNA, 20 nt, Artificial Sequence
  synthesized
gggcugagccaguuccuucc

SEQ ID NO: 1399 - RNA, 20 nt, Artificial Sequence
  synthesized
gggcugagccgguuccuucc

SEQ ID NO: 1400 - RNA, 20 nt, Artificial Sequence
  synthesized
ggugggaaggaaccggcuca

SEQ ID NO: 1401 - RNA, 20 nt, Artificial Sequence
  synthesized
ggugggaaggaacuggcuca

SEQ ID NO: 1402 - RNA, 20 nt, Artificial Sequence
  synthesized
gguuccuucccaccuucacu

SEQ ID NO: 1403 - RNA, 20 nt, Artificial Sequence
  synthesized
gugaaggugggaaggaaccg

SEQ ID NO: 1404 - RNA, 20 nt, Artificial Sequence
  synthesized
gugaaggugggaaggaacug

SEQ ID NO: 1405 - RNA, 20 nt, Artificial Sequence
  synthesized
gugggaaggaaccggcucag

SEQ ID NO: 1406 - RNA, 20 nt, Artificial Sequence
  synthesized
gugggaaggaacuggcucag

SEQ ID NO: 1407 - RNA, 20 nt, Artificial Sequence
  synthesized
gugggcagggcugagccagu

SEQ ID NO: 1408 - RNA, 20 nt, Artificial Sequence
  synthesized
gugggcagggcugagccggu

SEQ ID NO: 1409 - RNA, 20 nt, Artificial Sequence
  synthesized
ugagccaguuccuucccacc

SEQ ID NO: 1410 - RNA, 20 nt, Artificial Sequence
  synthesized
ugagccgguuccuucccacc

SEQ ID NO: 1411 - RNA, 20 nt, Artificial Sequence
  synthesized
uggcucagcccugcccacuc

SEQ ID NO: 1412 - RNA, 20 nt, Artificial Sequence
  synthesized
ugggaaggaaccggcucagc

SEQ ID NO: 1413 - RNA, 20 nt, Artificial Sequence
  synthesized
ugggaaggaacuggcucagc

SEQ ID NO: 1414 - RNA, 20 nt, Artificial Sequence
  synthesized
ugggcagggcugagccgguu

SEQ ID NO: 1415 - RNA, 20 nt, Artificial Sequence
  synthesized
cucuuaaaaauuucugcucc

SEQ ID NO: 1416 - RNA, 20 nt, Artificial Sequence
  synthesized
acccucaagcaguccagaaa

SEQ ID NO: 1417 - RNA, 20 nt, Artificial Sequence
  synthesized
acccucgagcaguccagaaa

SEQ ID NO: 1418 - RNA, 20 nt, Artificial Sequence
  synthesized
acugacccucaagcagucca

SEQ ID NO: 1419 - RNA, 20 nt, Artificial Sequence
  synthesized
acugacccucgagcagucca

SEQ ID NO: 1420 - RNA, 20 nt, Artificial Sequence
  synthesized
acugcucgagggucaguuau

SEQ ID NO: 1421 - RNA, 20 nt, Artificial Sequence
  synthesized
acugcuugagggucaguuau

SEQ ID NO: 1422 - RNA, 20 nt, Artificial Sequence
  synthesized
auaacugacccucaagcagu

SEQ ID NO: 1423 - RNA, 20 nt, Artificial Sequence
  synthesized
auaacugacccucgagcagu

SEQ ID NO: 1424 - RNA, 20 nt, Artificial Sequence
  synthesized
auauaacugacccucaagca

SEQ ID NO: 1425 - RNA, 20 nt, Artificial Sequence
  synthesized
auauaacugacccucgagca

SEQ ID NO: 1426 - RNA, 20 nt, Artificial Sequence
  synthesized
caagcaguccagaaaaaaua

SEQ ID NO: 1427 - RNA, 20 nt, Artificial Sequence
  synthesized
cccucaagcaguccagaaaa

SEQ ID NO: 1428 - RNA, 20 nt, Artificial Sequence
  synthesized
cccucgagcaguccagaaaa

SEQ ID NO: 1429 - RNA, 20 nt, Artificial Sequence
  synthesized
ccucaagcaguccagaaaaa

SEQ ID NO: 1430 - RNA, 20 nt, Artificial Sequence
  synthesized
ccucgagcaguccagaaaaa

SEQ ID NO: 1431 - RNA, 20 nt, Artificial Sequence
  synthesized
cgagcaguccagaaaaaaua

SEQ ID NO: 1432 - RNA, 20 nt, Artificial Sequence
  synthesized
cgagggucaguuauauacau

SEQ ID NO: 1433 - RNA, 20 nt, Artificial Sequence
  synthesized
cucaagcaguccagaaaaaa

SEQ ID NO: 1434 - RNA, 20 nt, Artificial Sequence
  synthesized
cucgagcaguccagaaaaaa

SEQ ID NO: 1435 - RNA, 20 nt, Artificial Sequence
  synthesized
cucgagggucaguuauauac

SEQ ID NO: 1436 - RNA, 20 nt, Artificial Sequence
  synthesized
cugacccucaagcaguccag

SEQ ID NO: 1437 - RNA, 20 nt, Artificial Sequence
  synthesized
cugacccucgagcaguccag

SEQ ID NO: 1438 - RNA, 20 nt, Artificial Sequence
  synthesized
cugcucgagggucaguuaua

SEQ ID NO: 1439 - RNA, 20 nt, Artificial Sequence
  synthesized
cugcuugagggucaguuaua

SEQ ID NO: 1440 - RNA, 20 nt, Artificial Sequence
  synthesized
cuggacugcucgagggucag

SEQ ID NO: 1441 - RNA, 20 nt, Artificial Sequence
  synthesized
cuggacugcuugagggucag

SEQ ID NO: 1442 - RNA, 20 nt, Artificial Sequence
  synthesized
cuugagggucaguuauauac

SEQ ID NO: 1443 - RNA, 20 nt, Artificial Sequence
  synthesized
gacccucgagcaguccagaa

SEQ ID NO: 1444 - RNA, 20 nt, Artificial Sequence
  synthesized
gacugcucgagggucaguua

SEQ ID NO: 1445 - RNA, 20 nt, Artificial Sequence
  synthesized
gacugcuugagggucaguua

SEQ ID NO: 1446 - RNA, 20 nt, Artificial Sequence
  synthesized
gagcaguccagaaaaaauau

SEQ ID NO: 1447 - RNA, 20 nt, Artificial Sequence
  synthesized
gcucgagggucaguuauaua

SEQ ID NO: 1448 - RNA, 20 nt, Artificial Sequence
  synthesized
gcuugagggucaguuauaua

SEQ ID NO: 1449 - RNA, 20 nt, Artificial Sequence
  synthesized
ggacugcucgagggucaguu

SEQ ID NO: 1450 - RNA, 20 nt, Artificial Sequence
  synthesized
ggacugcuugagggucaguu

SEQ ID NO: 1451 - RNA, 20 nt, Artificial Sequence
  synthesized
guauauaacugacccucaag

SEQ ID NO: 1452 - RNA, 20 nt, Artificial Sequence
  synthesized
guauauaacugacccucgag

SEQ ID NO: 1453 - RNA, 20 nt, Artificial Sequence
  synthesized
uaacugacccucaagcaguc

SEQ ID NO: 1454 - RNA, 20 nt, Artificial Sequence
  synthesized
uaacugacccucgagcaguc

SEQ ID NO: 1455 - RNA, 20 nt, Artificial Sequence
  synthesized
uauaacugacccucaagcag

SEQ ID NO: 1456 - RNA, 20 nt, Artificial Sequence
  synthesized
uauaacugacccucgagcag

SEQ ID NO: 1457 - RNA, 20 nt, Artificial Sequence
  synthesized
uauauaacugacccucaagc

SEQ ID NO: 1458 - RNA, 20 nt, Artificial Sequence
  synthesized
uauauaacugacccucgagc

SEQ ID NO: 1459 - RNA, 20 nt, Artificial Sequence
  synthesized
ucaagcaguccagaaaaaau

SEQ ID NO: 1460 - RNA, 20 nt, Artificial Sequence
  synthesized
ucgagcaguccagaaaaaau

SEQ ID NO: 1461 - RNA, 20 nt, Artificial Sequence
  synthesized
ucuggacugcucgaggguca

SEQ ID NO: 1462 - RNA, 20 nt, Artificial Sequence
  synthesized
ucuggacugcuugaggguca

SEQ ID NO: 1463 - RNA, 20 nt, Artificial Sequence
  synthesized
ugagggucaguuauauacau

SEQ ID NO: 1464 - RNA, 20 nt, Artificial Sequence
  synthesized
ugcucgagggucaguuauau

SEQ ID NO: 1465 - RNA, 20 nt, Artificial Sequence
  synthesized
ugcuugagggucaguuauau

SEQ ID NO: 1466 - RNA, 20 nt, Artificial Sequence
  synthesized
uggacugcucgagggucagu

SEQ ID NO: 1467 - RNA, 20 nt, Artificial Sequence
  synthesized
uggacugcuugagggucagu

SEQ ID NO: 1468 - RNA, 20 nt, Artificial Sequence
  synthesized
uguauauaacugacccucaa

SEQ ID NO: 1469 - RNA, 20 nt, Artificial Sequence
  synthesized
uguauauaacugacccucga

SEQ ID NO: 1470 - RNA, 20 nt, Artificial Sequence
  synthesized
uucuggacugcucgaggguc

SEQ ID NO: 1471 - RNA, 20 nt, Artificial Sequence
  synthesized
uucuggacugcuugaggguc

SEQ ID NO: 1472 - RNA, 20 nt, Artificial Sequence
  synthesized
uuucuggacugcucgagggu

SEQ ID NO: 1473 - RNA, 20 nt, Artificial Sequence
  synthesized
uuucuggacugcuugagggu

SEQ ID NO: 1474 - RNA, 20 nt, Artificial Sequence
  synthesized
acacggaggagagggcgggg

SEQ ID NO: 1475 - RNA, 20 nt, Artificial Sequence
  synthesized
acacggcggagagggcgggg

SEQ ID NO: 1476 - RNA, 20 nt, Artificial Sequence
  synthesized
agccccccgcccucuccgcc

SEQ ID NO: 1477 - RNA, 20 nt, Artificial Sequence
  synthesized
agccccccgcccucuccucc

SEQ ID NO: 1478 - RNA, 20 nt, Artificial Sequence
  synthesized
aggagagggcggggggcugc

SEQ ID NO: 1479 - RNA, 20 nt, Artificial Sequence
  synthesized
cacggaggagagggcggggg

SEQ ID NO: 1480 - RNA, 20 nt, Artificial Sequence
  synthesized
cacggcggagagggcggggg

SEQ ID NO: 1481 - RNA, 20 nt, Artificial Sequence
  synthesized
cccaccgugaacacggagga

SEQ ID NO: 1482 - RNA, 20 nt, Artificial Sequence
  synthesized
cccaccgugaacacggcgga

SEQ ID NO: 1483 - RNA, 20 nt, Artificial Sequence
  synthesized
cccccaccgugaacacggag

SEQ ID NO: 1484 - RNA, 20 nt, Artificial Sequence
  synthesized
cccccaccgugaacacggcg

SEQ ID NO: 1485 - RNA, 20 nt, Artificial Sequence
  synthesized
ccccccgcccucuccgccgu

SEQ ID NO: 1486 - RNA, 20 nt, Artificial Sequence
  synthesized
ccccccgcccucuccuccgu

SEQ ID NO: 1487 - RNA, 20 nt, Artificial Sequence
  synthesized
cccccgcccucuccgccgug

SEQ ID NO: 1488 - RNA, 20 nt, Artificial Sequence
  synthesized
cccccgcccucuccuccgug

SEQ ID NO: 1489 - RNA, 20 nt, Artificial Sequence
  synthesized
ccccgcccucuccgccgugu

SEQ ID NO: 1490 - RNA, 20 nt, Artificial Sequence
  synthesized
ccccgcccucuccuccgugu

SEQ ID NO: 1491 - RNA, 20 nt, Artificial Sequence
  synthesized
cccgcccucuccgccguguu

SEQ ID NO: 1492 - RNA, 20 nt, Artificial Sequence
  synthesized
cccgcccucuccuccguguu

SEQ ID NO: 1493 - RNA, 20 nt, Artificial Sequence
  synthesized
cccucuccgccguguucacg

SEQ ID NO: 1494 - RNA, 20 nt, Artificial Sequence
  synthesized
cccucuccuccguguucacg

SEQ ID NO: 1495 - RNA, 20 nt, Artificial Sequence
  synthesized
ccgcccucuccgccguguuc

SEQ ID NO: 1496 - RNA, 20 nt, Artificial Sequence
  synthesized
ccgcccucuccuccguguuc

SEQ ID NO: 1497 - RNA, 20 nt, Artificial Sequence
  synthesized
ccgccguguucacggugggg

SEQ ID NO: 1498 - RNA, 20 nt, Artificial Sequence
  synthesized
ccgugaacacggaggagagg

SEQ ID NO: 1499 - RNA, 20 nt, Artificial Sequence
  synthesized
ccgugaacacggcggagagg

SEQ ID NO: 1500 - RNA, 20 nt, Artificial Sequence
  synthesized
ccuccguguucacggugggg

SEQ ID NO: 1501 - RNA, 20 nt, Artificial Sequence
  synthesized
cgccguguucacgguggggg

SEQ ID NO: 1502 - RNA, 20 nt, Artificial Sequence
  synthesized
cggagagggcggggggcugc

SEQ ID NO: 1503 - RNA, 20 nt, Artificial Sequence
  synthesized
cuccguguucacgguggggg

SEQ ID NO: 1504 - RNA, 20 nt, Artificial Sequence
  synthesized
cugcagccccccgcccucuc

SEQ ID NO: 1505 - RNA, 20 nt, Artificial Sequence
  synthesized
gccccccgcccucuccgccg

SEQ ID NO: 1506 - RNA, 20 nt, Artificial Sequence
  synthesized
gccccccgcccucuccuccg

SEQ ID NO: 1507 - RNA, 20 nt, Artificial Sequence
  synthesized
gccguguucacggugggggu

SEQ ID NO: 1508 - RNA, 20 nt, Artificial Sequence
  synthesized
gcggagagggcggggggcug

SEQ ID NO: 1509 - RNA, 20 nt, Artificial Sequence
  synthesized
gcugcagccccccgcccucu

SEQ ID NO: 1510 - RNA, 20 nt, Artificial Sequence
  synthesized
ggaggagagggcggggggcu

SEQ ID NO: 1511 - RNA, 20 nt, Artificial Sequence
  synthesized
uccgccguguucacgguggg

SEQ ID NO: 1512 - RNA, 20 nt, Artificial Sequence
  synthesized
uccguguucacggugggggu

SEQ ID NO: 1513 - RNA, 20 nt, Artificial Sequence
  synthesized
uccuccguguucacgguggg

SEQ ID NO: 1514 - RNA, 20 nt, Artificial Sequence
  synthesized
acauuguucucuggugacug

SEQ ID NO: 1515 - RNA, 20 nt, Artificial Sequence
  synthesized
accagaggacaaugugaaag

SEQ ID NO: 1516 - RNA, 20 nt, Artificial Sequence
  synthesized
agaggacaaugugaaagcag

SEQ ID NO: 1517 - RNA, 20 nt, Artificial Sequence
  synthesized
agcagucaccagagaacaau

SEQ ID NO: 1518 - RNA, 20 nt, Artificial Sequence
  synthesized
aggacaaugugaaagcagaa

SEQ ID NO: 1519 - RNA, 20 nt, Artificial Sequence
  synthesized
agucaccagaggacaaugug

SEQ ID NO: 1520 - RNA, 20 nt, Artificial Sequence
  synthesized
auuguccucuggugacugcu

SEQ ID NO: 1521 - RNA, 20 nt, Artificial Sequence
  synthesized
auuguucucuggugacugcu

SEQ ID NO: 1522 - RNA, 20 nt, Artificial Sequence
  synthesized
cacauuguucucuggugacu

SEQ ID NO: 1523 - RNA, 20 nt, Artificial Sequence
  synthesized
caccagaggacaaugugaaa

SEQ ID NO: 1524 - RNA, 20 nt, Artificial Sequence
  synthesized
cagaggacaaugugaaagca

SEQ ID NO: 1525 - RNA, 20 nt, Artificial Sequence
  synthesized
cauuguccucuggugacugc

SEQ ID NO: 1526 - RNA, 20 nt, Artificial Sequence
  synthesized
cauuguucucuggugacugc

SEQ ID NO: 1527 - RNA, 20 nt, Artificial Sequence
  synthesized
ccucuggugacugcugcccc

SEQ ID NO: 1528 - RNA, 20 nt, Artificial Sequence
  synthesized
cuucugcuuucacauugucc

SEQ ID NO: 1529 - RNA, 20 nt, Artificial Sequence
  synthesized
cuuucacauuguccucuggu

SEQ ID NO: 1530 - RNA, 20 nt, Artificial Sequence
  synthesized
gaggacaaugugaaagcaga

SEQ ID NO: 1531 - RNA, 20 nt, Artificial Sequence
  synthesized
gcagcagucaccagagaaca

SEQ ID NO: 1532 - RNA, 20 nt, Artificial Sequence
  synthesized
gcuucugcuuucacauuguc

SEQ ID NO: 1533 - RNA, 20 nt, Artificial Sequence
  synthesized
ggacaaugugaaagcagaag

SEQ ID NO: 1534 - RNA, 20 nt, Artificial Sequence
  synthesized
ggcagcagucaccagagaac

SEQ ID NO: 1535 - RNA, 20 nt, Artificial Sequence
  synthesized
ggcagcagucaccagaggac

SEQ ID NO: 1536 - RNA, 20 nt, Artificial Sequence
  synthesized
gggcagcagucaccagagaa

SEQ ID NO: 1537 - RNA, 20 nt, Artificial Sequence
  synthesized
gggcagcagucaccagagga

SEQ ID NO: 1538 - RNA, 20 nt, Artificial Sequence
  synthesized
ggggcagcagucaccagaga

SEQ ID NO: 1539 - RNA, 20 nt, Artificial Sequence
  synthesized
ggggcagcagucaccagagg

SEQ ID NO: 1540 - RNA, 20 nt, Artificial Sequence
  synthesized
gggggcagcagucaccagag

SEQ ID NO: 1541 - RNA, 20 nt, Artificial Sequence
  synthesized
guucucuggugacugcugcc

SEQ ID NO: 1542 - RNA, 20 nt, Artificial Sequence
  synthesized
ucacauuguucucuggugac

SEQ ID NO: 1543 - RNA, 20 nt, Artificial Sequence
  synthesized
ucaccagaggacaaugugaa

SEQ ID NO: 1544 - RNA, 20 nt, Artificial Sequence
  synthesized
uccucuggugacugcugccc

SEQ ID NO: 1545 - RNA, 20 nt, Artificial Sequence
  synthesized
ucucuggugacugcugcccc

SEQ ID NO: 1546 - RNA, 20 nt, Artificial Sequence
  synthesized
ugcuuucacauuguccucug

SEQ ID NO: 1547 - RNA, 20 nt, Artificial Sequence
  synthesized
uguucucuggugacugcugc

SEQ ID NO: 1548 - RNA, 20 nt, Artificial Sequence
  synthesized
uucacauuguccucugguga

SEQ ID NO: 1549 - RNA, 20 nt, Artificial Sequence
  synthesized
uucacauuguucucugguga

SEQ ID NO: 1550 - RNA, 20 nt, Artificial Sequence
  synthesized
uucucuggugacugcugccc

SEQ ID NO: 1551 - RNA, 20 nt, Artificial Sequence
  synthesized
uucugcuuucacauuguccu

SEQ ID NO: 1552 - RNA, 20 nt, Artificial Sequence
  synthesized
uuguccucuggugacugcug

SEQ ID NO: 1553 - RNA, 20 nt, Artificial Sequence
  synthesized
uuguucucuggugacugcug

SEQ ID NO: 1554 - RNA, 20 nt, Artificial Sequence
  synthesized
uuucacauuguccucuggug

SEQ ID NO: 1555 - RNA, 20 nt, Artificial Sequence
  synthesized
aagagcccgaggaacacagc

SEQ ID NO: 1556 - RNA, 20 nt, Artificial Sequence
  synthesized
aagagcccggggaacacagc

SEQ ID NO: 1557 - RNA, 20 nt, Artificial Sequence
  synthesized
agaagagcccgaggaacaca

SEQ ID NO: 1558 - RNA, 20 nt, Artificial Sequence
  synthesized
agaagagcccggggaacaca

SEQ ID NO: 1559 - RNA, 20 nt, Artificial Sequence
  synthesized
agagcccgaggaacacagcc

SEQ ID NO: 1560 - RNA, 20 nt, Artificial Sequence
  synthesized
agagcccggggaacacagcc

SEQ ID NO: 1561 - RNA, 20 nt, Artificial Sequence
  synthesized
agcccgaggaacacagccca

SEQ ID NO: 1562 - RNA, 20 nt, Artificial Sequence
  synthesized
agcccggggaacacagccca

SEQ ID NO: 1563 - RNA, 20 nt, Artificial Sequence
  synthesized
aggaacacagcccagcaaug

SEQ ID NO: 1564 - RNA, 20 nt, Artificial Sequence
  synthesized
agguccagaagagcccgagg

SEQ ID NO: 1565 - RNA, 20 nt, Artificial Sequence
  synthesized
agguccagaagagcccgggg

SEQ ID NO: 1566 - RNA, 20 nt, Artificial Sequence
  synthesized
cagaagagcccgaggaacac

SEQ ID NO: 1567 - RNA, 20 nt, Artificial Sequence
  synthesized
cagaagagcccggggaacac

SEQ ID NO: 1568 - RNA, 20 nt, Artificial Sequence
  synthesized
ccagaagagcccgaggaaca

SEQ ID NO: 1569 - RNA, 20 nt, Artificial Sequence
  synthesized
ccagaagagcccggggaaca

SEQ ID NO: 1570 - RNA, 20 nt, Artificial Sequence
  synthesized
ccccgggcucuucuggaccu

SEQ ID NO: 1571 - RNA, 20 nt, Artificial Sequence
  synthesized
cccgggcucuucuggaccuu

SEQ ID NO: 1572 - RNA, 20 nt, Artificial Sequence
  synthesized
ccgggcucuucuggaccuug

SEQ ID NO: 1573 - RNA, 20 nt, Artificial Sequence
  synthesized
ccggggaacacagcccagca

SEQ ID NO: 1574 - RNA, 20 nt, Artificial Sequence
  synthesized
cucgggcucuucuggaccuu

SEQ ID NO: 1575 - RNA, 20 nt, Artificial Sequence
  synthesized
cugggcuguguuccccgggc

SEQ ID NO: 1576 - RNA, 20 nt, Artificial Sequence
  synthesized
cugggcuguguuccucgggc

SEQ ID NO: 1577 - RNA, 20 nt, Artificial Sequence
  synthesized
gagcccgaggaacacagccc

SEQ ID NO: 1578 - RNA, 20 nt, Artificial Sequence
  synthesized
gagcccggggaacacagccc

SEQ ID NO: 1579 - RNA, 20 nt, Artificial Sequence
  synthesized
gaggaacacagcccagcaau

SEQ ID NO: 1580 - RNA, 20 nt, Artificial Sequence
  synthesized
gcauugcugggcuguguucc

SEQ ID NO: 1581 - RNA, 20 nt, Artificial Sequence
  synthesized
gcugggcuguguuccccggg

SEQ ID NO: 1582 - RNA, 20 nt, Artificial Sequence
  synthesized
gcugggcuguguuccucggg

SEQ ID NO: 1583 - RNA, 20 nt, Artificial Sequence
  synthesized
ggcuguguuccccgggcucu

SEQ ID NO: 1584 - RNA, 20 nt, Artificial Sequence
  synthesized
ggcuguguuccucgggcucu

SEQ ID NO: 1585 - RNA, 20 nt, Artificial Sequence
  synthesized
gggaacacagcccagcaaug

SEQ ID NO: 1586 - RNA, 20 nt, Artificial Sequence
  synthesized
gggcuguguuccccgggcuc

SEQ ID NO: 1587 - RNA, 20 nt, Artificial Sequence
  synthesized
gggcuguguuccucgggcuc

SEQ ID NO: 1588 - RNA, 20 nt, Artificial Sequence
  synthesized
ggggaacacagcccagcaau

SEQ ID NO: 1589 - RNA, 20 nt, Artificial Sequence
  synthesized
gguccagaagagcccgagga

SEQ ID NO: 1590 - RNA, 20 nt, Artificial Sequence
  synthesized
gguccagaagagcccgggga

SEQ ID NO: 1591 - RNA, 20 nt, Artificial Sequence
  synthesized
guguuccccgggcucuucug

SEQ ID NO: 1592 - RNA, 20 nt, Artificial Sequence
  synthesized
guguuccucgggcucuucug

SEQ ID NO: 1593 - RNA, 20 nt, Artificial Sequence
  synthesized
guuccccgggcucuucugga

SEQ ID NO: 1594 - RNA, 20 nt, Artificial Sequence
  synthesized
guuccucgggcucuucugga

SEQ ID NO: 1595 - RNA, 20 nt, Artificial Sequence
  synthesized
uccagaagagcccgaggaac

SEQ ID NO: 1596 - RNA, 20 nt, Artificial Sequence
  synthesized
uccagaagagcccggggaac

SEQ ID NO: 1597 - RNA, 20 nt, Artificial Sequence
  synthesized
ucgggcucuucuggaccuug

SEQ ID NO: 1598 - RNA, 20 nt, Artificial Sequence
  synthesized
ugcugggcuguguuccccgg

SEQ ID NO: 1599 - RNA, 20 nt, Artificial Sequence
  synthesized
ugcugggcuguguuccucgg

SEQ ID NO: 1600 - RNA, 20 nt, Artificial Sequence
  synthesized
ugggcuguguuccccgggcu

SEQ ID NO: 1601 - RNA, 20 nt, Artificial Sequence
  synthesized
ugggcuguguuccucgggcu

SEQ ID NO: 1602 - RNA, 20 nt, Artificial Sequence
  synthesized
uguuccccgggcucuucugg

SEQ ID NO: 1603 - RNA, 20 nt, Artificial Sequence
  synthesized
uguuccucgggcucuucugg

SEQ ID NO: 1604 - RNA, 20 nt, Artificial Sequence
  synthesized
uuccccgggcucuucuggac

SEQ ID NO: 1605 - RNA, 20 nt, Artificial Sequence
  synthesized
uuccucgggcucuucuggac

SEQ ID NO: 1606 - RNA, 20 nt, Artificial Sequence
  synthesized
uugcugggcuguguuccccg

SEQ ID NO: 1607 - RNA, 20 nt, Artificial Sequence
  synthesized
uugcugggcuguguuccucg

SEQ ID NO: 1608 - RNA, 20 nt, Artificial Sequence
  synthesized
agagagagagagagagaaaa

SEQ ID NO: 1609 - RNA, 20 nt, Artificial Sequence
  synthesized
gagagagagagaaaaaaaga

SEQ ID NO: 1610 - RNA, 20 nt, Artificial Sequence
  synthesized
uuucucucucucucucucuc

SEQ ID NO: 1611 - RNA, 20 nt, Artificial Sequence
  synthesized
acugcuucaucaggaggaua

SEQ ID NO: 1612 - RNA, 20 nt, Artificial Sequence
  synthesized
acugcuucaucagguggaua

SEQ ID NO: 1613 - RNA, 20 nt, Artificial Sequence
  synthesized
agcacugcuucaucaggugg

SEQ ID NO: 1614 - RNA, 20 nt, Artificial Sequence
  synthesized
aggaggauacacucgacagg

SEQ ID NO: 1615 - RNA, 20 nt, Artificial Sequence
  synthesized
aggauacacucgacaggugc

SEQ ID NO: 1616 - RNA, 20 nt, Artificial Sequence
  synthesized
agguggauacacucgacagg

SEQ ID NO: 1617 - RNA, 20 nt, Artificial Sequence
  synthesized
aguguauccaccugaugaag

SEQ ID NO: 1618 - RNA, 20 nt, Artificial Sequence
  synthesized
aguguauccuccugaugaag

SEQ ID NO: 1619 - RNA, 20 nt, Artificial Sequence
  synthesized
caccugucgaguguauccac

SEQ ID NO: 1620 - RNA, 20 nt, Artificial Sequence
  synthesized
caccugucgaguguauccuc

SEQ ID NO: 1621 - RNA, 20 nt, Artificial Sequence
  synthesized
cacugcuucaucagguggau

SEQ ID NO: 1622 - RNA, 20 nt, Artificial Sequence
  synthesized
cagcacugcuucaucaggag

SEQ ID NO: 1623 - RNA, 20 nt, Artificial Sequence
  synthesized
cagcacugcuucaucaggug

SEQ ID NO: 1624 - RNA, 20 nt, Artificial Sequence
  synthesized
caggaggauacacucgacag

SEQ ID NO: 1625 - RNA, 20 nt, Artificial Sequence
  synthesized
cagguggauacacucgacag

SEQ ID NO: 1626 - RNA, 20 nt, Artificial Sequence
  synthesized
caucaggaggauacacucga

SEQ ID NO: 1627 - RNA, 20 nt, Artificial Sequence
  synthesized
caucagguggauacacucga

SEQ ID NO: 1628 - RNA, 20 nt, Artificial Sequence
  synthesized
ccugucgaguguauccaccu

SEQ ID NO: 1629 - RNA, 20 nt, Artificial Sequence
  synthesized
ccugucgaguguauccuccu

SEQ ID NO: 1630 - RNA, 20 nt, Artificial Sequence
  synthesized
cgaguguauccaccugauga

SEQ ID NO: 1631 - RNA, 20 nt, Artificial Sequence
  synthesized
cgaguguauccuccugauga

SEQ ID NO: 1632 - RNA, 20 nt, Artificial Sequence
  synthesized
cuccugaugaagcagugcug

SEQ ID NO: 1633 - RNA, 20 nt, Artificial Sequence
  synthesized
cugcccagcacugcuucauc

SEQ ID NO: 1634 - RNA, 20 nt, Artificial Sequence
  synthesized
cugcuucaucaggaggauac

SEQ ID NO: 1635 - RNA, 20 nt, Artificial Sequence
  synthesized
cugcuucaucagguggauac

SEQ ID NO: 1636 - RNA, 20 nt, Artificial Sequence
  synthesized
cugucgaguguauccaccug

SEQ ID NO: 1637 - RNA, 20 nt, Artificial Sequence
  synthesized
cugucgaguguauccuccug

SEQ ID NO: 1638 - RNA, 20 nt, Artificial Sequence
  synthesized
gaguguauccaccugaugaa

SEQ ID NO: 1639 - RNA, 20 nt, Artificial Sequence
  synthesized
gaguguauccuccugaugaa

SEQ ID NO: 1640 - RNA, 20 nt, Artificial Sequence
  synthesized
gcaccugucgaguguaucca

SEQ ID NO: 1641 - RNA, 20 nt, Artificial Sequence
  synthesized
gcaccugucgaguguauccu

SEQ ID NO: 1642 - RNA, 20 nt, Artificial Sequence
  synthesized
gcacugcuucaucaggugga

SEQ ID NO: 1643 - RNA, 20 nt, Artificial Sequence
  synthesized
gcuucaucaggaggauacac

SEQ ID NO: 1644 - RNA, 20 nt, Artificial Sequence
  synthesized
gcuucaucagguggauacac

SEQ ID NO: 1645 - RNA, 20 nt, Artificial Sequence
  synthesized
ggaggauacacucgacaggu

SEQ ID NO: 1646 - RNA, 20 nt, Artificial Sequence
  synthesized
gguggauacacucgacaggu

SEQ ID NO: 1647 - RNA, 20 nt, Artificial Sequence
  synthesized
guauccaccugaugaagcag

SEQ ID NO: 1648 - RNA, 20 nt, Artificial Sequence
  synthesized
gucgaguguauccaccugau

SEQ ID NO: 1649 - RNA, 20 nt, Artificial Sequence
  synthesized
gucgaguguauccuccugau

SEQ ID NO: 1650 - RNA, 20 nt, Artificial Sequence
  synthesized
uauccaccugaugaagcagu

SEQ ID NO: 1651 - RNA, 20 nt, Artificial Sequence
  synthesized
uauccuccugaugaagcagu

SEQ ID NO: 1652 - RNA, 20 nt, Artificial Sequence
  synthesized
ucaucaggaggauacacucg

SEQ ID NO: 1653 - RNA, 20 nt, Artificial Sequence
  synthesized
ucaucagguggauacacucg

SEQ ID NO: 1654 - RNA, 20 nt, Artificial Sequence
  synthesized
uccugaugaagcagugcugg

SEQ ID NO: 1655 - RNA, 20 nt, Artificial Sequence
  synthesized
ucgaguguauccaccugaug

SEQ ID NO: 1656 - RNA, 20 nt, Artificial Sequence
  synthesized
ucgaguguauccuccugaug

SEQ ID NO: 1657 - RNA, 20 nt, Artificial Sequence
  synthesized
uggauacacucgacaggugc

SEQ ID NO: 1658 - RNA, 20 nt, Artificial Sequence
  synthesized
uguauccaccugaugaagca

SEQ ID NO: 1659 - RNA, 20 nt, Artificial Sequence
  synthesized
uucaucaggaggauacacuc

SEQ ID NO: 1660 - RNA, 20 nt, Artificial Sequence
  synthesized
uucaucagguggauacacuc

SEQ ID NO: 1661 - RNA, 20 nt, Artificial Sequence
  synthesized
aacgccccacccaagccagg

SEQ ID NO: 1662 - RNA, 20 nt, Artificial Sequence
  synthesized
aacgucccacccaagccagg

SEQ ID NO: 1663 - RNA, 20 nt, Artificial Sequence
  synthesized
acaccuggcuugggugggac

SEQ ID NO: 1664 - RNA, 20 nt, Artificial Sequence
  synthesized
acaccuggcuuggguggggc

SEQ ID NO: 1665 - RNA, 20 nt, Artificial Sequence
  synthesized
accuggcuugggugggacgu

SEQ ID NO: 1666 - RNA, 20 nt, Artificial Sequence
  synthesized
accuggcuuggguggggcgu

SEQ ID NO: 1667 - RNA, 20 nt, Artificial Sequence
  synthesized
acgccccacccaagccaggu

SEQ ID NO: 1668 - RNA, 20 nt, Artificial Sequence
  synthesized
acgucccacccaagccaggu

SEQ ID NO: 1669 - RNA, 20 nt, Artificial Sequence
  synthesized
caccuggcuugggugggacg

SEQ ID NO: 1670 - RNA, 20 nt, Artificial Sequence
  synthesized
caccuggcuuggguggggcg

SEQ ID NO: 1671 - RNA, 20 nt, Artificial Sequence
  synthesized
ccccucugcugccugcagaa

SEQ ID NO: 1672 - RNA, 20 nt, Artificial Sequence
  synthesized
cccucugcugccugcagaac

SEQ ID NO: 1673 - RNA, 20 nt, Artificial Sequence
  synthesized
ccugcagaacgccccaccca

SEQ ID NO: 1674 - RNA, 20 nt, Artificial Sequence
  synthesized
ccugcagaacgucccaccca

SEQ ID NO: 1675 - RNA, 20 nt, Artificial Sequence
  synthesized
ccuggcuugggugggacguu

SEQ ID NO: 1676 - RNA, 20 nt, Artificial Sequence
  synthesized
ccuggcuuggguggggcguu

SEQ ID NO: 1677 - RNA, 20 nt, Artificial Sequence
  synthesized
cgccccacccaagccaggug

SEQ ID NO: 1678 - RNA, 20 nt, Artificial Sequence
  synthesized
cgucccacccaagccaggug

SEQ ID NO: 1679 - RNA, 20 nt, Artificial Sequence
  synthesized
cucugcugccugcagaacgc

SEQ ID NO: 1680 - RNA, 20 nt, Artificial Sequence
  synthesized
cucugcugccugcagaacgu

SEQ ID NO: 1681 - RNA, 20 nt, Artificial Sequence
  synthesized
cugcagaacgccccacccaa

SEQ ID NO: 1682 - RNA, 20 nt, Artificial Sequence
  synthesized
cugcagaacgucccacccaa

SEQ ID NO: 1683 - RNA, 20 nt, Artificial Sequence
  synthesized
cugcugccugcagaacgccc

SEQ ID NO: 1684 - RNA, 20 nt, Artificial Sequence
  synthesized
cugcugccugcagaacgucc

SEQ ID NO: 1685 - RNA, 20 nt, Artificial Sequence
  synthesized
cuggcuugggugggacguuc

SEQ ID NO: 1686 - RNA, 20 nt, Artificial Sequence
  synthesized
cuggcuuggguggggcguuc

SEQ ID NO: 1687 - RNA, 20 nt, Artificial Sequence
  synthesized
gaacgccccacccaagccag

SEQ ID NO: 1688 - RNA, 20 nt, Artificial Sequence
  synthesized
gaacgucccacccaagccag

SEQ ID NO: 1689 - RNA, 20 nt, Artificial Sequence
  synthesized
gacaccuggcuuggguggga

SEQ ID NO: 1690 - RNA, 20 nt, Artificial Sequence
  synthesized
gacaccuggcuugggugggg

SEQ ID NO: 1691 - RNA, 20 nt, Artificial Sequence
  synthesized
gcagaacgccccacccaagc

SEQ ID NO: 1692 - RNA, 20 nt, Artificial Sequence
  synthesized
gcagaacgucccacccaagc

SEQ ID NO: 1693 - RNA, 20 nt, Artificial Sequence
  synthesized
gccugcagaacgccccaccc

SEQ ID NO: 1694 - RNA, 20 nt, Artificial Sequence
  synthesized
gccugcagaacgucccaccc

SEQ ID NO: 1695 - RNA, 20 nt, Artificial Sequence
  synthesized
gcugccugcagaacgcccca

SEQ ID NO: 1696 - RNA, 20 nt, Artificial Sequence
  synthesized
gcugccugcagaacguccca

SEQ ID NO: 1697 - RNA, 20 nt, Artificial Sequence
  synthesized
ggcuugggugggacguucug

SEQ ID NO: 1698 - RNA, 20 nt, Artificial Sequence
  synthesized
ggcuuggguggggcguucug

SEQ ID NO: 1699 - RNA, 20 nt, Artificial Sequence
  synthesized
gggugggacguucugcaggc

SEQ ID NO: 1700 - RNA, 20 nt, Artificial Sequence
  synthesized
ggguggggcguucugcaggc

SEQ ID NO: 1701 - RNA, 20 nt, Artificial Sequence
  synthesized
ggugggacguucugcaggca

SEQ ID NO: 1702 - RNA, 20 nt, Artificial Sequence
  synthesized
gguggggcguucugcaggca

SEQ ID NO: 1703 - RNA, 20 nt, Artificial Sequence
  synthesized
gugggacguucugcaggcag

SEQ ID NO: 1704 - RNA, 20 nt, Artificial Sequence
  synthesized
guggggcguucugcaggcag

SEQ ID NO: 1705 - RNA, 20 nt, Artificial Sequence
  synthesized
ucccacccaagccagguguc

SEQ ID NO: 1706 - RNA, 20 nt, Artificial Sequence
  synthesized
ucugcugccugcagaacgcc

SEQ ID NO: 1707 - RNA, 20 nt, Artificial Sequence
  synthesized
ucugcugccugcagaacguc

SEQ ID NO: 1708 - RNA, 20 nt, Artificial Sequence
  synthesized
ugcagaacgccccacccaag

SEQ ID NO: 1709 - RNA, 20 nt, Artificial Sequence
  synthesized
ugcagaacgucccacccaag

SEQ ID NO: 1710 - RNA, 20 nt, Artificial Sequence
  synthesized
ugccugcagaacgucccacc

SEQ ID NO: 1711 - RNA, 20 nt, Artificial Sequence
  synthesized
ugcugccugcagaacgcccc

SEQ ID NO: 1712 - RNA, 20 nt, Artificial Sequence
  synthesized
ugcugccugcagaacguccc

SEQ ID NO: 1713 - RNA, 20 nt, Artificial Sequence
  synthesized
ugggugggacguucugcagg

SEQ ID NO: 1714 - RNA, 20 nt, Artificial Sequence
  synthesized
uggguggggcguucugcagg

SEQ ID NO: 1715 - RNA, 20 nt, Artificial Sequence
  synthesized
uugggugggacguucugcag

SEQ ID NO: 1716 - RNA, 20 nt, Artificial Sequence
  synthesized
uuggguggggcguucugcag

SEQ ID NO: 1717 - RNA, 20 nt, Artificial Sequence
  synthesized
aaguucccugauuauaccca

SEQ ID NO: 1718 - RNA, 20 nt, Artificial Sequence
  synthesized
aaguucccugauuaugccca

SEQ ID NO: 1719 - RNA, 20 nt, Artificial Sequence
  synthesized
acccacaggagaagcagcca

SEQ ID NO: 1720 - RNA, 20 nt, Artificial Sequence
  synthesized
acuugggcaaguucccugau

SEQ ID NO: 1721 - RNA, 20 nt, Artificial Sequence
  synthesized
auacccacaggagaagcagc

SEQ ID NO: 1722 - RNA, 20 nt, Artificial Sequence
  synthesized
augcccacaggagaagcagc

SEQ ID NO: 1723 - RNA, 20 nt, Artificial Sequence
  synthesized
auuauacccacaggagaagc

SEQ ID NO: 1724 - RNA, 20 nt, Artificial Sequence
  synthesized
auuaugcccacaggagaagc

SEQ ID NO: 1725 - RNA, 20 nt, Artificial Sequence
  synthesized
caaguucccugauuauaccc

SEQ ID NO: 1726 - RNA, 20 nt, Artificial Sequence
  synthesized
caaguucccugauuaugccc

SEQ ID NO: 1727 - RNA, 20 nt, Artificial Sequence
  synthesized
cauaaucagggaacuugccc

SEQ ID NO: 1728 - RNA, 20 nt, Artificial Sequence
  synthesized
cccugauuauacccacagga

SEQ ID NO: 1729 - RNA, 20 nt, Artificial Sequence
  synthesized
cccugauuaugcccacagga

SEQ ID NO: 1730 - RNA, 20 nt, Artificial Sequence
  synthesized
ccugauuauacccacaggag

SEQ ID NO: 1731 - RNA, 20 nt, Artificial Sequence
  synthesized
ccugauuaugcccacaggag

SEQ ID NO: 1732 - RNA, 20 nt, Artificial Sequence
  synthesized
ccugugggcauaaucaggga

SEQ ID NO: 1733 - RNA, 20 nt, Artificial Sequence
  synthesized
ccuguggguauaaucaggga

SEQ ID NO: 1734 - RNA, 20 nt, Artificial Sequence
  synthesized
cuccugugggcauaaucagg

SEQ ID NO: 1735 - RNA, 20 nt, Artificial Sequence
  synthesized
cuccuguggguauaaucagg

SEQ ID NO: 1736 - RNA, 20 nt, Artificial Sequence
  synthesized
cugcuucuccugugggcaua

SEQ ID NO: 1737 - RNA, 20 nt, Artificial Sequence
  synthesized
cugcuucuccuguggguaua

SEQ ID NO: 1738 - RNA, 20 nt, Artificial Sequence
  synthesized
cugugggcauaaucagggaa

SEQ ID NO: 1739 - RNA, 20 nt, Artificial Sequence
  synthesized
cuguggguauaaucagggaa

SEQ ID NO: 1740 - RNA, 20 nt, Artificial Sequence
  synthesized
gauuauacccacaggagaag

SEQ ID NO: 1741 - RNA, 20 nt, Artificial Sequence
  synthesized
gauuaugcccacaggagaag

SEQ ID NO: 1742 - RNA, 20 nt, Artificial Sequence
  synthesized
gcaaguucccugauuauacc

SEQ ID NO: 1743 - RNA, 20 nt, Artificial Sequence
  synthesized
gcaaguucccugauuaugcc

SEQ ID NO: 1744 - RNA, 20 nt, Artificial Sequence
  synthesized
gcauaaucagggaacuugcc

SEQ ID NO: 1745 - RNA, 20 nt, Artificial Sequence
  synthesized
gcccacaggagaagcagcca

SEQ ID NO: 1746 - RNA, 20 nt, Artificial Sequence
  synthesized
gcugcuucuccugugggcau

SEQ ID NO: 1747 - RNA, 20 nt, Artificial Sequence
  synthesized
gcugcuucuccuguggguau

SEQ ID NO: 1748 - RNA, 20 nt, Artificial Sequence
  synthesized
gcuucuccugugggcauaau

SEQ ID NO: 1749 - RNA, 20 nt, Artificial Sequence
  synthesized
gcuucuccuguggguauaau

SEQ ID NO: 1750 - RNA, 20 nt, Artificial Sequence
  synthesized
ggcaaguucccugauuauac

SEQ ID NO: 1751 - RNA, 20 nt, Artificial Sequence
  synthesized
ggcaaguucccugauuaugc

SEQ ID NO: 1752 - RNA, 20 nt, Artificial Sequence
  synthesized
ggcauaaucagggaacuugc

SEQ ID NO: 1753 - RNA, 20 nt, Artificial Sequence
  synthesized
ggcugcuucuccugugggca

SEQ ID NO: 1754 - RNA, 20 nt, Artificial Sequence
  synthesized
ggcugcuucuccugugggua

SEQ ID NO: 1755 - RNA, 20 nt, Artificial Sequence
  synthesized
gggcaaguucccugauuaua

SEQ ID NO: 1756 - RNA, 20 nt, Artificial Sequence
  synthesized
gggcaaguucccugauuaug

SEQ ID NO: 1757 - RNA, 20 nt, Artificial Sequence
  synthesized
gggcauaaucagggaacuug

SEQ ID NO: 1758 - RNA, 20 nt, Artificial Sequence
  synthesized
ggguauaaucagggaacuug

SEQ ID NO: 1759 - RNA, 20 nt, Artificial Sequence
  synthesized
gguauaaucagggaacuugc

SEQ ID NO: 1760 - RNA, 20 nt, Artificial Sequence
  synthesized
guauaaucagggaacuugcc

SEQ ID NO: 1761 - RNA, 20 nt, Artificial Sequence
  synthesized
gugggcauaaucagggaacu

SEQ ID NO: 1762 - RNA, 20 nt, Artificial Sequence
  synthesized
guggguauaaucagggaacu

SEQ ID NO: 1763 - RNA, 20 nt, Artificial Sequence
  synthesized
uacccacaggagaagcagcc

SEQ ID NO: 1764 - RNA, 20 nt, Artificial Sequence
  synthesized
uauacccacaggagaagcag

SEQ ID NO: 1765 - RNA, 20 nt, Artificial Sequence
  synthesized
uaugcccacaggagaagcag

SEQ ID NO: 1766 - RNA, 20 nt, Artificial Sequence
  synthesized
uccugugggcauaaucaggg

SEQ ID NO: 1767 - RNA, 20 nt, Artificial Sequence
  synthesized
uccuguggguauaaucaggg

SEQ ID NO: 1768 - RNA, 20 nt, Artificial Sequence
  synthesized
ugauuauacccacaggagaa

SEQ ID NO: 1769 - RNA, 20 nt, Artificial Sequence
  synthesized
ugauuaugcccacaggagaa

SEQ ID NO: 1770 - RNA, 20 nt, Artificial Sequence
  synthesized
ugcccacaggagaagcagcc

SEQ ID NO: 1771 - RNA, 20 nt, Artificial Sequence
  synthesized
ugcuucuccugugggcauaa

SEQ ID NO: 1772 - RNA, 20 nt, Artificial Sequence
  synthesized
ugcuucuccuguggguauaa

SEQ ID NO: 1773 - RNA, 20 nt, Artificial Sequence
  synthesized
uggcugcuucuccugugggc

SEQ ID NO: 1774 - RNA, 20 nt, Artificial Sequence
  synthesized
uggcugcuucuccugugggu

SEQ ID NO: 1775 - RNA, 20 nt, Artificial Sequence
  synthesized
ugggcauaaucagggaacuu

SEQ ID NO: 1776 - RNA, 20 nt, Artificial Sequence
  synthesized
uggguauaaucagggaacuu

SEQ ID NO: 1777 - RNA, 20 nt, Artificial Sequence
  synthesized
ugugggcauaaucagggaac

SEQ ID NO: 1778 - RNA, 20 nt, Artificial Sequence
  synthesized
uguggguauaaucagggaac

SEQ ID NO: 1779 - RNA, 20 nt, Artificial Sequence
  synthesized
uuauacccacaggagaagca

SEQ ID NO: 1780 - RNA, 20 nt, Artificial Sequence
  synthesized
uuaugcccacaggagaagca

SEQ ID NO: 1781 - RNA, 20 nt, Artificial Sequence
  synthesized
uucccugauuauacccacag

SEQ ID NO: 1782 - RNA, 20 nt, Artificial Sequence
  synthesized
uucccugauuaugcccacag

SEQ ID NO: 1783 - RNA, 20 nt, Artificial Sequence
  synthesized
aaucuaggggcaucgauggg

SEQ ID NO: 1784 - RNA, 20 nt, Artificial Sequence
  synthesized
aggggcaucgaugggaaauu

SEQ ID NO: 1785 - RNA, 20 nt, Artificial Sequence
  synthesized
aggggcauugaugggaaauu

SEQ ID NO: 1786 - RNA, 20 nt, Artificial Sequence
  synthesized
aucaaugccccuagauucuu

SEQ ID NO: 1787 - RNA, 20 nt, Artificial Sequence
  synthesized
aucgaugccccuagauucuu

SEQ ID NO: 1788 - RNA, 20 nt, Artificial Sequence
  synthesized
aucgaugggaaauugcaacc

SEQ ID NO: 1789 - RNA, 20 nt, Artificial Sequence
  synthesized
aucuaggggcaucgauggga

SEQ ID NO: 1790 - RNA, 20 nt, Artificial Sequence
  synthesized
aucuaggggcauugauggga

SEQ ID NO: 1791 - RNA, 20 nt, Artificial Sequence
  synthesized
auugaugggaaauugcaacc

SEQ ID NO: 1792 - RNA, 20 nt, Artificial Sequence
  synthesized
auuucccaucgaugccccua

SEQ ID NO: 1793 - RNA, 20 nt, Artificial Sequence
  synthesized
caaugccccuagauucuucc

SEQ ID NO: 1794 - RNA, 20 nt, Artificial Sequence
  synthesized
caauuucccaucaaugcccc

SEQ ID NO: 1795 - RNA, 20 nt, Artificial Sequence
  synthesized
caauuucccaucgaugcccc

SEQ ID NO: 1796 - RNA, 20 nt, Artificial Sequence
  synthesized
caucaaugccccuagauucu

SEQ ID NO: 1797 - RNA, 20 nt, Artificial Sequence
  synthesized
caucgaugccccuagauucu

SEQ ID NO: 1798 - RNA, 20 nt, Artificial Sequence
  synthesized
caucgaugggaaauugcaac

SEQ ID NO: 1799 - RNA, 20 nt, Artificial Sequence
  synthesized
cauugaugggaaauugcaac

SEQ ID NO: 1800 - RNA, 20 nt, Artificial Sequence
  synthesized
ccaucaaugccccuagauuc

SEQ ID NO: 1801 - RNA, 20 nt, Artificial Sequence
  synthesized
ccaucgaugccccuagauuc

SEQ ID NO: 1802 - RNA, 20 nt, Artificial Sequence
  synthesized
cccaucaaugccccuagauu

SEQ ID NO: 1803 - RNA, 20 nt, Artificial Sequence
  synthesized
cccaucgaugccccuagauu

SEQ ID NO: 1804 - RNA, 20 nt, Artificial Sequence
  synthesized
cgaugccccuagauucuucc

SEQ ID NO: 1805 - RNA, 20 nt, Artificial Sequence
  synthesized
cuaggggcaucgaugggaaa

SEQ ID NO: 1806 - RNA, 20 nt, Artificial Sequence
  synthesized
cuaggggcauugaugggaaa

SEQ ID NO: 1807 - RNA, 20 nt, Artificial Sequence
  synthesized
gaaucuaggggcaucgaugg

SEQ ID NO: 1808 - RNA, 20 nt, Artificial Sequence
  synthesized
gaaucuaggggcauugaugg

SEQ ID NO: 1809 - RNA, 20 nt, Artificial Sequence
  synthesized
gcaauuucccaucaaugccc

SEQ ID NO: 1810 - RNA, 20 nt, Artificial Sequence
  synthesized
gcaauuucccaucgaugccc

SEQ ID NO: 1811 - RNA, 20 nt, Artificial Sequence
  synthesized
gcaucgaugggaaauugcaa

SEQ ID NO: 1812 - RNA, 20 nt, Artificial Sequence
  synthesized
gcauugaugggaaauugcaa

SEQ ID NO: 1813 - RNA, 20 nt, Artificial Sequence
  synthesized
ggaagaaucuaggggcaucg

SEQ ID NO: 1814 - RNA, 20 nt, Artificial Sequence
  synthesized
ggaagaaucuaggggcauug

SEQ ID NO: 1815 - RNA, 20 nt, Artificial Sequence
  synthesized
ggcaucgaugggaaauugca

SEQ ID NO: 1816 - RNA, 20 nt, Artificial Sequence
  synthesized
ggcauugaugggaaauugca

SEQ ID NO: 1817 - RNA, 20 nt, Artificial Sequence
  synthesized
gggcaucgaugggaaauugc

SEQ ID NO: 1818 - RNA, 20 nt, Artificial Sequence
  synthesized
gggcauugaugggaaauugc

SEQ ID NO: 1819 - RNA, 20 nt, Artificial Sequence
  synthesized
ggggcaucgaugggaaauug

SEQ ID NO: 1820 - RNA, 20 nt, Artificial Sequence
  synthesized
ggggcauugaugggaaauug

SEQ ID NO: 1821 - RNA, 20 nt, Artificial Sequence
  synthesized
gggguugcaauuucccauca

SEQ ID NO: 1822 - RNA, 20 nt, Artificial Sequence
  synthesized
gggguugcaauuucccaucg

SEQ ID NO: 1823 - RNA, 20 nt, Artificial Sequence
  synthesized
ggguugcaauuucccaucaa

SEQ ID NO: 1824 - RNA, 20 nt, Artificial Sequence
  synthesized
ggguugcaauuucccaucga

SEQ ID NO: 1825 - RNA, 20 nt, Artificial Sequence
  synthesized
gguugcaauuucccaucaau

SEQ ID NO: 1826 - RNA, 20 nt, Artificial Sequence
  synthesized
gguugcaauuucccaucgau

SEQ ID NO: 1827 - RNA, 20 nt, Artificial Sequence
  synthesized
guugcaauuucccaucaaug

SEQ ID NO: 1828 - RNA, 20 nt, Artificial Sequence
  synthesized
guugcaauuucccaucgaug

SEQ ID NO: 1829 - RNA, 20 nt, Artificial Sequence
  synthesized
ucaaugccccuagauucuuc

SEQ ID NO: 1830 - RNA, 20 nt, Artificial Sequence
  synthesized
ucccaucaaugccccuagau

SEQ ID NO: 1831 - RNA, 20 nt, Artificial Sequence
  synthesized
ucccaucgaugccccuagau

SEQ ID NO: 1832 - RNA, 20 nt, Artificial Sequence
  synthesized
ucgaugccccuagauucuuc

SEQ ID NO: 1833 - RNA, 20 nt, Artificial Sequence
  synthesized
ucgaugggaaauugcaaccc

SEQ ID NO: 1834 - RNA, 20 nt, Artificial Sequence
  synthesized
ucuaggggcaucgaugggaa

SEQ ID NO: 1835 - RNA, 20 nt, Artificial Sequence
  synthesized
ucuaggggcauugaugggaa

SEQ ID NO: 1836 - RNA, 20 nt, Artificial Sequence
  synthesized
uggaagaaucuaggggcauc

SEQ ID NO: 1837 - RNA, 20 nt, Artificial Sequence
  synthesized
uggaagaaucuaggggcauu

SEQ ID NO: 1838 - RNA, 20 nt, Artificial Sequence
  synthesized
uucccaucaaugccccuaga

SEQ ID NO: 1839 - RNA, 20 nt, Artificial Sequence
  synthesized
uucccaucgaugccccuaga

SEQ ID NO: 1840 - RNA, 20 nt, Artificial Sequence
  synthesized
uugaugggaaauugcaaccc

SEQ ID NO: 1841 - RNA, 20 nt, Artificial Sequence
  synthesized
uugcaauuucccaucaaugc

SEQ ID NO: 1842 - RNA, 20 nt, Artificial Sequence
  synthesized
uugcaauuucccaucgaugc

SEQ ID NO: 1843 - RNA, 20 nt, Artificial Sequence
  synthesized
uuucccaucaaugccccuag

SEQ ID NO: 1844 - RNA, 20 nt, Artificial Sequence
  synthesized
uuucccaucgaugccccuag

SEQ ID NO: 1845 - RNA, 20 nt, Artificial Sequence
  synthesized
aaauccccugcuggacucag

SEQ ID NO: 1846 - RNA, 20 nt, Artificial Sequence
  synthesized
aauccccugcuggacucagg

SEQ ID NO: 1847 - RNA, 20 nt, Artificial Sequence
  synthesized
aaucccugacccucaaaucc

SEQ ID NO: 1848 - RNA, 20 nt, Artificial Sequence
  synthesized
aaucccugacccucacaucc

SEQ ID NO: 1849 - RNA, 20 nt, Artificial Sequence
  synthesized
acccucaaauccccugcugg

SEQ ID NO: 1850 - RNA, 20 nt, Artificial Sequence
  synthesized
acccucacauccccugcugg

SEQ ID NO: 1851 - RNA, 20 nt, Artificial Sequence
  synthesized
agaaucccugacccucaaau

SEQ ID NO: 1852 - RNA, 20 nt, Artificial Sequence
  synthesized
agaaucccugacccucacau

SEQ ID NO: 1853 - RNA, 20 nt, Artificial Sequence
  synthesized
agcccugaguccagcagggg

SEQ ID NO: 1854 - RNA, 20 nt, Artificial Sequence
  synthesized
aggggaugugagggucaggg

SEQ ID NO: 1855 - RNA, 20 nt, Artificial Sequence
  synthesized
aggggauuugagggucaggg

SEQ ID NO: 1856 - RNA, 20 nt, Artificial Sequence
  synthesized
aguccagcaggggaugugag

SEQ ID NO: 1857 - RNA, 20 nt, Artificial Sequence
  synthesized
aguccagcaggggauuugag

SEQ ID NO: 1858 - RNA, 20 nt, Artificial Sequence
  synthesized
aucccugacccucaaauccc

SEQ ID NO: 1859 - RNA, 20 nt, Artificial Sequence
  synthesized
augugagggucagggauucu

SEQ ID NO: 1860 - RNA, 20 nt, Artificial Sequence
  synthesized
auuugagggucagggauucu

SEQ ID NO: 1861 - RNA, 20 nt, Artificial Sequence
  synthesized
caggggaugugagggucagg

SEQ ID NO: 1862 - RNA, 20 nt, Artificial Sequence
  synthesized
caggggauuugagggucagg

SEQ ID NO: 1863 - RNA, 20 nt, Artificial Sequence
  synthesized
cauccccugcuggacucagg

SEQ ID NO: 1864 - RNA, 20 nt, Artificial Sequence
  synthesized
cccucaaauccccugcugga

SEQ ID NO: 1865 - RNA, 20 nt, Artificial Sequence
  synthesized
cccucacauccccugcugga

SEQ ID NO: 1866 - RNA, 20 nt, Artificial Sequence
  synthesized
cccugacccucaaauccccu

SEQ ID NO: 1867 - RNA, 20 nt, Artificial Sequence
  synthesized
cccugaguccagcaggggau

SEQ ID NO: 1868 - RNA, 20 nt, Artificial Sequence
  synthesized
ccucaaauccccugcuggac

SEQ ID NO: 1869 - RNA, 20 nt, Artificial Sequence
  synthesized
ccucacauccccugcuggac

SEQ ID NO: 1870 - RNA, 20 nt, Artificial Sequence
  synthesized
ccugacccucaaauccccug

SEQ ID NO: 1871 - RNA, 20 nt, Artificial Sequence
  synthesized
ccugacccucacauccccug

SEQ ID NO: 1872 - RNA, 20 nt, Artificial Sequence
  synthesized
cucaaauccccugcuggacu

SEQ ID NO: 1873 - RNA, 20 nt, Artificial Sequence
  synthesized
gaaucccugacccucaaauc

SEQ ID NO: 1874 - RNA, 20 nt, Artificial Sequence
  synthesized
gaaucccugacccucacauc

SEQ ID NO: 1875 - RNA, 20 nt, Artificial Sequence
  synthesized
gacccucaaauccccugcug

SEQ ID NO: 1876 - RNA, 20 nt, Artificial Sequence
  synthesized
gacccucacauccccugcug

SEQ ID NO: 1877 - RNA, 20 nt, Artificial Sequence
  synthesized
gagaaucccugacccucaaa

SEQ ID NO: 1878 - RNA, 20 nt, Artificial Sequence
  synthesized
gagaaucccugacccucaca

SEQ ID NO: 1879 - RNA, 20 nt, Artificial Sequence
  synthesized
gaugugagggucagggauuc

SEQ ID NO: 1880 - RNA, 20 nt, Artificial Sequence
  synthesized
gauuugagggucagggauuc

SEQ ID NO: 1881 - RNA, 20 nt, Artificial Sequence
  synthesized
ggagaaucccugacccucaa

SEQ ID NO: 1882 - RNA, 20 nt, Artificial Sequence
  synthesized
ggagaaucccugacccucac

SEQ ID NO: 1883 - RNA, 20 nt, Artificial Sequence
  synthesized
ggaugugagggucagggauu

SEQ ID NO: 1884 - RNA, 20 nt, Artificial Sequence
  synthesized
ggauuugagggucagggauu

SEQ ID NO: 1885 - RNA, 20 nt, Artificial Sequence
  synthesized
gggaugugagggucagggau

SEQ ID NO: 1886 - RNA, 20 nt, Artificial Sequence
  synthesized
gggauuugagggucagggau

SEQ ID NO: 1887 - RNA, 20 nt, Artificial Sequence
  synthesized
ggggaugugagggucaggga

SEQ ID NO: 1888 - RNA, 20 nt, Artificial Sequence
  synthesized
ggggauuugagggucaggga

SEQ ID NO: 1889 - RNA, 20 nt, Artificial Sequence
  synthesized
guccagcaggggaugugagg

SEQ ID NO: 1890 - RNA, 20 nt, Artificial Sequence
  synthesized
guccagcaggggauuugagg

SEQ ID NO: 1891 - RNA, 20 nt, Artificial Sequence
  synthesized
gugagggucagggauucucc

SEQ ID NO: 1892 - RNA, 20 nt, Artificial Sequence
  synthesized
uccagcaggggaugugaggg

SEQ ID NO: 1893 - RNA, 20 nt, Artificial Sequence
  synthesized
uccagcaggggauuugaggg

SEQ ID NO: 1894 - RNA, 20 nt, Artificial Sequence
  synthesized
ucccugacccucaaaucccc

SEQ ID NO: 1895 - RNA, 20 nt, Artificial Sequence
  synthesized
ugugagggucagggauucuc

SEQ ID NO: 1896 - RNA, 20 nt, Artificial Sequence
  synthesized
uugagggucagggauucucc

SEQ ID NO: 1897 - RNA, 20 nt, Artificial Sequence
  synthesized
uuugagggucagggauucuc

SEQ ID NO: 1898 - RNA, 20 nt, Artificial Sequence
  synthesized
aggggugggcugggagggca

SEQ ID NO: 1899 - RNA, 20 nt, Artificial Sequence
  synthesized
aucuggagcccagccaggua

SEQ ID NO: 1900 - RNA, 20 nt, Artificial Sequence
  synthesized
cagaugcccucccagcccac

SEQ ID NO: 1901 - RNA, 20 nt, Artificial Sequence
  synthesized
ccagaugcccucccagccca

SEQ ID NO: 1902 - RNA, 20 nt, Artificial Sequence
  synthesized
ccuggcugggcuccagaugc

SEQ ID NO: 1903 - RNA, 20 nt, Artificial Sequence
  synthesized
cuaccuggcugggcuccaga

SEQ ID NO: 1904 - RNA, 20 nt, Artificial Sequence
  synthesized
cuccagaugcccucccagcc

SEQ ID NO: 1905 - RNA, 20 nt, Artificial Sequence
  synthesized
cuggcugggcuccagaugcc

SEQ ID NO: 1906 - RNA, 20 nt, Artificial Sequence
  synthesized
cugggagggcaucuggagcc

SEQ ID NO: 1907 - RNA, 20 nt, Artificial Sequence
  synthesized
cugggcuccagaugcccucc

SEQ ID NO: 1908 - RNA, 20 nt, Artificial Sequence
  synthesized
gaaggggugggcugggaggg

SEQ ID NO: 1909 - RNA, 20 nt, Artificial Sequence
  synthesized
gagggcaucuggagcccagc

SEQ ID NO: 1910 - RNA, 20 nt, Artificial Sequence
  synthesized
gaugcccucccagcccaccc

SEQ ID NO: 1911 - RNA, 20 nt, Artificial Sequence
  synthesized
gcaucuggagcccagccagg

SEQ ID NO: 1912 - RNA, 20 nt, Artificial Sequence
  synthesized
gcuccagaugcccucccagc

SEQ ID NO: 1913 - RNA, 20 nt, Artificial Sequence
  synthesized
gcugggagggcaucuggagc

SEQ ID NO: 1914 - RNA, 20 nt, Artificial Sequence
  synthesized
gcugggcuccagaugcccuc

SEQ ID NO: 1915 - RNA, 20 nt, Artificial Sequence
  synthesized
ggcaucuggagcccagccag

SEQ ID NO: 1916 - RNA, 20 nt, Artificial Sequence
  synthesized
ggcuccagaugcccucccag

SEQ ID NO: 1917 - RNA, 20 nt, Artificial Sequence
  synthesized
gggagggcaucuggagccca

SEQ ID NO: 1918 - RNA, 20 nt, Artificial Sequence
  synthesized
gggcaucuggagcccagcca

SEQ ID NO: 1919 - RNA, 20 nt, Artificial Sequence
  synthesized
ggggugggcugggagggcau

SEQ ID NO: 1920 - RNA, 20 nt, Artificial Sequence
  synthesized
gugggcugggagggcaucug

SEQ ID NO: 1921 - RNA, 20 nt, Artificial Sequence
  synthesized
uaccuggcugggcuccagau

SEQ ID NO: 1922 - RNA, 20 nt, Artificial Sequence
  synthesized
uccagaugcccucccagccc

SEQ ID NO: 1923 - RNA, 20 nt, Artificial Sequence
  synthesized
ucuaccuggcugggcuccag

SEQ ID NO: 1924 - RNA, 20 nt, Artificial Sequence
  synthesized
uggcugggcuccagaugccc

SEQ ID NO: 1925 - RNA, 20 nt, Artificial Sequence
  synthesized
ugggagggcaucuggagccc

SEQ ID NO: 1926 - RNA, 20 nt, Artificial Sequence
  synthesized
ugggcuccagaugcccuccc

SEQ ID NO: 1927 - RNA, 20 nt, Artificial Sequence
  synthesized
ugggcugggagggcaucugg

SEQ ID NO: 1928 - RNA, 20 nt, Artificial Sequence
  synthesized
agagagagagaaagaaaaag

SEQ ID NO: 1929 - RNA, 20 nt, Artificial Sequence
  synthesized
cuuucucucucucucucucu

SEQ ID NO: 1930 - RNA, 20 nt, Artificial Sequence
  synthesized
gagagagagagagagaaaga

SEQ ID NO: 1931 - RNA, 20 nt, Artificial Sequence
  synthesized
acaggggacucuuacccucc

SEQ ID NO: 1932 - RNA, 20 nt, Artificial Sequence
  synthesized
acaggggacucuuacccucu

SEQ ID NO: 1933 - RNA, 20 nt, Artificial Sequence
  synthesized
acucuuacccucugcucugg

SEQ ID NO: 1934 - RNA, 20 nt, Artificial Sequence
  synthesized
agagcagaggguaagagucc

SEQ ID NO: 1935 - RNA, 20 nt, Artificial Sequence
  synthesized
agagcggaggguaagagucc

SEQ ID NO: 1936 - RNA, 20 nt, Artificial Sequence
  synthesized
agaggguaagaguccccugu

SEQ ID NO: 1937 - RNA, 20 nt, Artificial Sequence
  synthesized
aggggacucuuacccuccgc

SEQ ID NO: 1938 - RNA, 20 nt, Artificial Sequence
  synthesized
aggggacucuuacccucugc

SEQ ID NO: 1939 - RNA, 20 nt, Artificial Sequence
  synthesized
cagagcagaggguaagaguc

SEQ ID NO: 1940 - RNA, 20 nt, Artificial Sequence
  synthesized
cagagcggaggguaagaguc

SEQ ID NO: 1941 - RNA, 20 nt, Artificial Sequence
  synthesized
cagaggguaagaguccccug

SEQ ID NO: 1942 - RNA, 20 nt, Artificial Sequence
  synthesized
caggggacucuuacccuccg

SEQ ID NO: 1943 - RNA, 20 nt, Artificial Sequence
  synthesized
caggggacucuuacccucug

SEQ ID NO: 1944 - RNA, 20 nt, Artificial Sequence
  synthesized
ccagagcagaggguaagagu

SEQ ID NO: 1945 - RNA, 20 nt, Artificial Sequence
  synthesized
ccagagcggaggguaagagu

SEQ ID NO: 1946 - RNA, 20 nt, Artificial Sequence
  synthesized
cccagagcagaggguaagag

SEQ ID NO: 1947 - RNA, 20 nt, Artificial Sequence
  synthesized
ccucccagagcagaggguaa

SEQ ID NO: 1948 - RNA, 20 nt, Artificial Sequence
  synthesized
cggaggguaagaguccccug

SEQ ID NO: 1949 - RNA, 20 nt, Artificial Sequence
  synthesized
cucccagagcagaggguaag

SEQ ID NO: 1950 - RNA, 20 nt, Artificial Sequence
  synthesized
cucugcucugggaggcuccg

SEQ ID NO: 1951 - RNA, 20 nt, Artificial Sequence
  synthesized
cugcucugggaggcuccggu

SEQ ID NO: 1952 - RNA, 20 nt, Artificial Sequence
  synthesized
cuuacccucugcucugggag

SEQ ID NO: 1953 - RNA, 20 nt, Artificial Sequence
  synthesized
gagcagaggguaagaguccc

SEQ ID NO: 1954 - RNA, 20 nt, Artificial Sequence
  synthesized
gagccucccagagcagaggg

SEQ ID NO: 1955 - RNA, 20 nt, Artificial Sequence
  synthesized
gagcggaggguaagaguccc

SEQ ID NO: 1956 - RNA, 20 nt, Artificial Sequence
  synthesized
gcagaggguaagaguccccu

SEQ ID NO: 1957 - RNA, 20 nt, Artificial Sequence
  synthesized
gcggaggguaagaguccccu

SEQ ID NO: 1958 - RNA, 20 nt, Artificial Sequence
  synthesized
ggagccucccagagcagagg

SEQ ID NO: 1959 - RNA, 20 nt, Artificial Sequence
  synthesized
ggaggguaagaguccccugu

SEQ ID NO: 1960 - RNA, 20 nt, Artificial Sequence
  synthesized
ggggacucuuacccuccgcu

SEQ ID NO: 1961 - RNA, 20 nt, Artificial Sequence
  synthesized
ggggacucuuacccucugcu

SEQ ID NO: 1962 - RNA, 20 nt, Artificial Sequence
  synthesized
ucccagagcagaggguaaga

SEQ ID NO: 1963 - RNA, 20 nt, Artificial Sequence
  synthesized
ucuuacccucugcucuggga

SEQ ID NO: 1964 - RNA, 20 nt, Artificial Sequence
  synthesized
ugcucugggaggcuccggua

SEQ ID NO: 1965 - RNA, 20 nt, Artificial Sequence
  synthesized
uuacccucugcucugggagg

SEQ ID NO: 1966 - RNA, 20 nt, Artificial Sequence
  synthesized
aaugcaucaccaugaucacu

SEQ ID NO: 1967 - RNA, 20 nt, Artificial Sequence
  synthesized
acccagcagcaccgaaugca

SEQ ID NO: 1968 - RNA, 20 nt, Artificial Sequence
  synthesized
acccagcagcaccgagugca

SEQ ID NO: 1969 - RNA, 20 nt, Artificial Sequence
  synthesized
accgaaugcaucaccaugau

SEQ ID NO: 1970 - RNA, 20 nt, Artificial Sequence
  synthesized
accgagugcaucaccaugau

SEQ ID NO: 1971 - RNA, 20 nt, Artificial Sequence
  synthesized
acucggugcugcuggguggc

SEQ ID NO: 1972 - RNA, 20 nt, Artificial Sequence
  synthesized
agcaccgaaugcaucaccau

SEQ ID NO: 1973 - RNA, 20 nt, Artificial Sequence
  synthesized
agcaccgagugcaucaccau

SEQ ID NO: 1974 - RNA, 20 nt, Artificial Sequence
  synthesized
agugcaucaccaugaucacu

SEQ ID NO: 1975 - RNA, 20 nt, Artificial Sequence
  synthesized
aucauggugaugcacucggu

SEQ ID NO: 1976 - RNA, 20 nt, Artificial Sequence
  synthesized
aucauggugaugcauucggu

SEQ ID NO: 1977 - RNA, 20 nt, Artificial Sequence
  synthesized
augcaucaccaugaucacug

SEQ ID NO: 1978 - RNA, 20 nt, Artificial Sequence
  synthesized
auggugaugcacucggugcu

SEQ ID NO: 1979 - RNA, 20 nt, Artificial Sequence
  synthesized
auggugaugcauucggugcu

SEQ ID NO: 1980 - RNA, 20 nt, Artificial Sequence
  synthesized
auucggugcugcuggguggc

SEQ ID NO: 1981 - RNA, 20 nt, Artificial Sequence
  synthesized
cacccagcagcaccgaaugc

SEQ ID NO: 1982 - RNA, 20 nt, Artificial Sequence
  synthesized
cacccagcagcaccgagugc

SEQ ID NO: 1983 - RNA, 20 nt, Artificial Sequence
  synthesized
caccgaaugcaucaccauga

SEQ ID NO: 1984 - RNA, 20 nt, Artificial Sequence
  synthesized
caccgagugcaucaccauga

SEQ ID NO: 1985 - RNA, 20 nt, Artificial Sequence
  synthesized
cagcagcaccgaaugcauca

SEQ ID NO: 1986 - RNA, 20 nt, Artificial Sequence
  synthesized
cagcagcaccgagugcauca

SEQ ID NO: 1987 - RNA, 20 nt, Artificial Sequence
  synthesized
cagugaucauggugaugcac

SEQ ID NO: 1988 - RNA, 20 nt, Artificial Sequence
  synthesized
cagugaucauggugaugcau

SEQ ID NO: 1989 - RNA, 20 nt, Artificial Sequence
  synthesized
cauggugaugcacucggugc

SEQ ID NO: 1990 - RNA, 20 nt, Artificial Sequence
  synthesized
cauggugaugcauucggugc

SEQ ID NO: 1991 - RNA, 20 nt, Artificial Sequence
  synthesized
ccagcagcaccgaaugcauc

SEQ ID NO: 1992 - RNA, 20 nt, Artificial Sequence
  synthesized
ccagcagcaccgagugcauc

SEQ ID NO: 1993 - RNA, 20 nt, Artificial Sequence
  synthesized
cccagcagcaccgaaugcau

SEQ ID NO: 1994 - RNA, 20 nt, Artificial Sequence
  synthesized
cccagcagcaccgagugcau

SEQ ID NO: 1995 - RNA, 20 nt, Artificial Sequence
  synthesized
ccgaaugcaucaccaugauc

SEQ ID NO: 1996 - RNA, 20 nt, Artificial Sequence
  synthesized
ccgagugcaucaccaugauc

SEQ ID NO: 1997 - RNA, 20 nt, Artificial Sequence
  synthesized
cgaaugcaucaccaugauca

SEQ ID NO: 1998 - RNA, 20 nt, Artificial Sequence
  synthesized
cgagugcaucaccaugauca

SEQ ID NO: 1999 - RNA, 20 nt, Artificial Sequence
  synthesized
cgccacccagcagcaccgaa

SEQ ID NO: 2000 - RNA, 20 nt, Artificial Sequence
  synthesized
cgccacccagcagcaccgag

SEQ ID NO: 2001 - RNA, 20 nt, Artificial Sequence
  synthesized
gaaugcaucaccaugaucac

SEQ ID NO: 2002 - RNA, 20 nt, Artificial Sequence
  synthesized
gagugcaucaccaugaucac

SEQ ID NO: 2003 - RNA, 20 nt, Artificial Sequence
  synthesized
gaucauggugaugcacucgg

SEQ ID NO: 2004 - RNA, 20 nt, Artificial Sequence
  synthesized
gaucauggugaugcauucgg

SEQ ID NO: 2005 - RNA, 20 nt, Artificial Sequence
  synthesized
gaugcacucggugcugcugg

SEQ ID NO: 2006 - RNA, 20 nt, Artificial Sequence
  synthesized
gaugcauucggugcugcugg

SEQ ID NO: 2007 - RNA, 20 nt, Artificial Sequence
  synthesized
gcaccgaaugcaucaccaug

SEQ ID NO: 2008 - RNA, 20 nt, Artificial Sequence
  synthesized
gcaccgagugcaucaccaug

SEQ ID NO: 2009 - RNA, 20 nt, Artificial Sequence
  synthesized
gcacucggugcugcugggug

SEQ ID NO: 2010 - RNA, 20 nt, Artificial Sequence
  synthesized
gcagcaccgaaugcaucacc

SEQ ID NO: 2011 - RNA, 20 nt, Artificial Sequence
  synthesized
gcagcaccgagugcaucacc

SEQ ID NO: 2012 - RNA, 20 nt, Artificial Sequence
  synthesized
gcauucggugcugcugggug

SEQ ID NO: 2013 - RNA, 20 nt, Artificial Sequence
  synthesized
gccacccagcagcaccgaau

SEQ ID NO: 2014 - RNA, 20 nt, Artificial Sequence
  synthesized
gccacccagcagcaccgagu

SEQ ID NO: 2015 - RNA, 20 nt, Artificial Sequence
  synthesized
gugcaucaccaugaucacug

SEQ ID NO: 2016 - RNA, 20 nt, Artificial Sequence
  synthesized
ucauggugaugcacucggug

SEQ ID NO: 2017 - RNA, 20 nt, Artificial Sequence
  synthesized
ucauggugaugcauucggug

SEQ ID NO: 2018 - RNA, 20 nt, Artificial Sequence
  synthesized
ugaucauggugaugcacucg

SEQ ID NO: 2019 - RNA, 20 nt, Artificial Sequence
  synthesized
ugaucauggugaugcauucg

SEQ ID NO: 2020 - RNA, 20 nt, Artificial Sequence
  synthesized
uggugaugcacucggugcug

SEQ ID NO: 2021 - RNA, 20 nt, Artificial Sequence
  synthesized
uggugaugcauucggugcug

SEQ ID NO: 2022 - RNA, 20 nt, Artificial Sequence
  synthesized
aaaaggugaucgaguucauu

SEQ ID NO: 2023 - RNA, 20 nt, Artificial Sequence
  synthesized
aaaggugaucgaguucauua

SEQ ID NO: 2024 - RNA, 20 nt, Artificial Sequence
  synthesized
aaauggugaucgaguucauu

SEQ ID NO: 2025 - RNA, 20 nt, Artificial Sequence
  synthesized
aacaccugguauuaaaaggu

SEQ ID NO: 2026 - RNA, 20 nt, Artificial Sequence
  synthesized
aacaccugguauuaaauggu

SEQ ID NO: 2027 - RNA, 20 nt, Artificial Sequence
  synthesized
aaggugaucgaguucauuaa

SEQ ID NO: 2028 - RNA, 20 nt, Artificial Sequence
  synthesized
aaugaacucgaucaccauuu

SEQ ID NO: 2029 - RNA, 20 nt, Artificial Sequence
  synthesized
aauggugaucgaguucauua

SEQ ID NO: 2030 - RNA, 20 nt, Artificial Sequence
  synthesized
acaccugguauuaaaaggug

SEQ ID NO: 2031 - RNA, 20 nt, Artificial Sequence
  synthesized
acaccugguauuaaauggug

SEQ ID NO: 2032 - RNA, 20 nt, Artificial Sequence
  synthesized
accauuuaauaccagguguu

SEQ ID NO: 2033 - RNA, 20 nt, Artificial Sequence
  synthesized
acucgaucaccauuuaauac

SEQ ID NO: 2034 - RNA, 20 nt, Artificial Sequence
  synthesized
aucaccauuuaauaccaggu

SEQ ID NO: 2035 - RNA, 20 nt, Artificial Sequence
  synthesized
augaacucgaucaccauuua

SEQ ID NO: 2036 - RNA, 20 nt, Artificial Sequence
  synthesized
auggugaucgaguucauuaa

SEQ ID NO: 2037 - RNA, 20 nt, Artificial Sequence
  synthesized
caccauuuaauaccaggugu

SEQ ID NO: 2038 - RNA, 20 nt, Artificial Sequence
  synthesized
caccugguauuaaaagguga

SEQ ID NO: 2039 - RNA, 20 nt, Artificial Sequence
  synthesized
caccugguauuaaaugguga

SEQ ID NO: 2040 - RNA, 20 nt, Artificial Sequence
  synthesized
ccauuuaauaccagguguuu

SEQ ID NO: 2041 - RNA, 20 nt, Artificial Sequence
  synthesized
ccugguauuaaaaggugauc

SEQ ID NO: 2042 - RNA, 20 nt, Artificial Sequence
  synthesized
ccugguauuaaauggugauc

SEQ ID NO: 2043 - RNA, 20 nt, Artificial Sequence
  synthesized
cgaucaccauuuaauaccag

SEQ ID NO: 2044 - RNA, 20 nt, Artificial Sequence
  synthesized
cugguauuaaaaggugaucg

SEQ ID NO: 2045 - RNA, 20 nt, Artificial Sequence
  synthesized
cugguauuaaauggugaucg

SEQ ID NO: 2046 - RNA, 20 nt, Artificial Sequence
  synthesized
gaacucgaucaccauuuaau

SEQ ID NO: 2047 - RNA, 20 nt, Artificial Sequence
  synthesized
gaucaccauuuaauaccagg

SEQ ID NO: 2048 - RNA, 20 nt, Artificial Sequence
  synthesized
gguauuaaaaggugaucgag

SEQ ID NO: 2049 - RNA, 20 nt, Artificial Sequence
  synthesized
gguauuaaauggugaucgag

SEQ ID NO: 2050 - RNA, 20 nt, Artificial Sequence
  synthesized
guauuaaaaggugaucgagu

SEQ ID NO: 2051 - RNA, 20 nt, Artificial Sequence
  synthesized
guauuaaauggugaucgagu

SEQ ID NO: 2052 - RNA, 20 nt, Artificial Sequence
  synthesized
uaaaaggugaucgaguucau

SEQ ID NO: 2053 - RNA, 20 nt, Artificial Sequence
  synthesized
uaaauggugaucgaguucau

SEQ ID NO: 2054 - RNA, 20 nt, Artificial Sequence
  synthesized
uaaugaacucgaucaccauu

SEQ ID NO: 2055 - RNA, 20 nt, Artificial Sequence
  synthesized
uaaugaacucgaucaccuuu

SEQ ID NO: 2056 - RNA, 20 nt, Artificial Sequence
  synthesized
ugaacucgaucaccauuuaa

SEQ ID NO: 2057 - RNA, 20 nt, Artificial Sequence
  synthesized
ugguauuaaaaggugaucga

SEQ ID NO: 2058 - RNA, 20 nt, Artificial Sequence
  synthesized
ugguauuaaauggugaucga

SEQ ID NO: 2059 - RNA, 20 nt, Artificial Sequence
  synthesized
agugagacucagaaaaaaag

SEQ ID NO: 2060 - RNA, 20 nt, Artificial Sequence
  synthesized
gacaaagugagacucagaaa

SEQ ID NO: 2061 - RNA, 20 nt, Artificial Sequence
  synthesized
uucugagucucacuuuguca

SEQ ID NO: 2062 - RNA, 20 nt, Artificial Sequence
  synthesized
ucuucuucuuucauaccuca

SEQ ID NO: 2063 - RNA, 20 nt, Artificial Sequence
  synthesized
accacgcgggaccgcagagc

SEQ ID NO: 2064 - RNA, 20 nt, Artificial Sequence
  synthesized
accgcgcgggaccgcagagc

SEQ ID NO: 2065 - RNA, 20 nt, Artificial Sequence
  synthesized
acggagcccaccacgcggga

SEQ ID NO: 2066 - RNA, 20 nt, Artificial Sequence
  synthesized
acggagcccaccgcgcggga

SEQ ID NO: 2067 - RNA, 20 nt, Artificial Sequence
  synthesized
caccacgcgggaccgcagag

SEQ ID NO: 2068 - RNA, 20 nt, Artificial Sequence
  synthesized
caccgcgcgggaccgcagag

SEQ ID NO: 2069 - RNA, 20 nt, Artificial Sequence
  synthesized
ccaccacgcgggaccgcaga

SEQ ID NO: 2070 - RNA, 20 nt, Artificial Sequence
  synthesized
ccaccgcgcgggaccgcaga

SEQ ID NO: 2071 - RNA, 20 nt, Artificial Sequence
  synthesized
cccaccacgcgggaccgcag

SEQ ID NO: 2072 - RNA, 20 nt, Artificial Sequence
  synthesized
cccaccgcgcgggaccgcag

SEQ ID NO: 2073 - RNA, 20 nt, Artificial Sequence
  synthesized
cccgcgcggugggcuccguc

SEQ ID NO: 2074 - RNA, 20 nt, Artificial Sequence
  synthesized
cccgcguggugggcuccguc

SEQ ID NO: 2075 - RNA, 20 nt, Artificial Sequence
  synthesized
ccgcgcggugggcuccgucc

SEQ ID NO: 2076 - RNA, 20 nt, Artificial Sequence
  synthesized
ccgcguggugggcuccgucc

SEQ ID NO: 2077 - RNA, 20 nt, Artificial Sequence
  synthesized
cgcguggugggcuccguccc

SEQ ID NO: 2078 - RNA, 20 nt, Artificial Sequence
  synthesized
cggagcccaccacgcgggac

SEQ ID NO: 2079 - RNA, 20 nt, Artificial Sequence
  synthesized
cggagcccaccgcgcgggac

SEQ ID NO: 2080 - RNA, 20 nt, Artificial Sequence
  synthesized
cggucccgcgcggugggcuc

SEQ ID NO: 2081 - RNA, 20 nt, Artificial Sequence
  synthesized
cggucccgcguggugggcuc

SEQ ID NO: 2082 - RNA, 20 nt, Artificial Sequence
  synthesized
cggugggcuccgucccugcc

SEQ ID NO: 2083 - RNA, 20 nt, Artificial Sequence
  synthesized
cucugcggucccgcgcggug

SEQ ID NO: 2084 - RNA, 20 nt, Artificial Sequence
  synthesized
cucugcggucccgcguggug

SEQ ID NO: 2085 - RNA, 20 nt, Artificial Sequence
  synthesized
gacggagcccaccacgcggg

SEQ ID NO: 2086 - RNA, 20 nt, Artificial Sequence
  synthesized
gacggagcccaccgcgcggg

SEQ ID NO: 2087 - RNA, 20 nt, Artificial Sequence
  synthesized
gcagggacggagcccaccac

SEQ ID NO: 2088 - RNA, 20 nt, Artificial Sequence
  synthesized
gcagggacggagcccaccgc

SEQ ID NO: 2089 - RNA, 20 nt, Artificial Sequence
  synthesized
gcccaccacgcgggaccgca

SEQ ID NO: 2090 - RNA, 20 nt, Artificial Sequence
  synthesized
gcccaccgcgcgggaccgca

SEQ ID NO: 2091 - RNA, 20 nt, Artificial Sequence
  synthesized
gcgcggugggcuccgucccu

SEQ ID NO: 2092 - RNA, 20 nt, Artificial Sequence
  synthesized
gcggucccgcgcggugggcu

SEQ ID NO: 2093 - RNA, 20 nt, Artificial Sequence
  synthesized
gcggucccgcguggugggcu

SEQ ID NO: 2094 - RNA, 20 nt, Artificial Sequence
  synthesized
gcggugggcuccgucccugc

SEQ ID NO: 2095 - RNA, 20 nt, Artificial Sequence
  synthesized
gcguggugggcuccgucccu

SEQ ID NO: 2096 - RNA, 20 nt, Artificial Sequence
  synthesized
ggagcccaccacgcgggacc

SEQ ID NO: 2097 - RNA, 20 nt, Artificial Sequence
  synthesized
ggagcccaccgcgcgggacc

SEQ ID NO: 2098 - RNA, 20 nt, Artificial Sequence
  synthesized
gggcucugcggucccgcgcg

SEQ ID NO: 2099 - RNA, 20 nt, Artificial Sequence
  synthesized
gggcucugcggucccgcgug

SEQ ID NO: 2100 - RNA, 20 nt, Artificial Sequence
  synthesized
ggucccgcgcggugggcucc

SEQ ID NO: 2101 - RNA, 20 nt, Artificial Sequence
  synthesized
ggucccgcguggugggcucc

SEQ ID NO: 2102 - RNA, 20 nt, Artificial Sequence
  synthesized
gucccgcgcggugggcuccg

SEQ ID NO: 2103 - RNA, 20 nt, Artificial Sequence
  synthesized
gucccgcguggugggcuccg

SEQ ID NO: 2104 - RNA, 20 nt, Artificial Sequence
  synthesized
guggugggcuccgucccugc

SEQ ID NO: 2105 - RNA, 20 nt, Artificial Sequence
  synthesized
ucccgcgcggugggcuccgu

SEQ ID NO: 2106 - RNA, 20 nt, Artificial Sequence
  synthesized
ucccgcguggugggcuccgu

SEQ ID NO: 2107 - RNA, 20 nt, Artificial Sequence
  synthesized
ucugcggucccgcgcggugg

SEQ ID NO: 2108 - RNA, 20 nt, Artificial Sequence
  synthesized
ucugcggucccgcguggugg

SEQ ID NO: 2109 - RNA, 20 nt, Artificial Sequence
  synthesized
ugcggucccgcgcggugggc

SEQ ID NO: 2110 - RNA, 20 nt, Artificial Sequence
  synthesized
ugcggucccgcguggugggc

SEQ ID NO: 2111 - RNA, 20 nt, Artificial Sequence
  synthesized
uggugggcuccgucccugcc

SEQ ID NO: 2112 - RNA, 20 nt, Artificial Sequence
  synthesized
acccuaaggagaagaacaaa

SEQ ID NO: 2113 - RNA, 20 nt, Artificial Sequence
  synthesized
agacccuaaggagaagaaca

SEQ ID NO: 2114 - RNA, 20 nt, Artificial Sequence
  synthesized
cagacccuaaggagaagaac

SEQ ID NO: 2115 - RNA, 20 nt, Artificial Sequence
  synthesized
ccagacccuaaggagaagaa

SEQ ID NO: 2116 - RNA, 20 nt, Artificial Sequence
  synthesized
cccagacccuaaggagaaga

SEQ ID NO: 2117 - RNA, 20 nt, Artificial Sequence
  synthesized
cccuaaggagaagaacaaaa

SEQ ID NO: 2118 - RNA, 20 nt, Artificial Sequence
  synthesized
ccuaaggagaagaacaaaaa

SEQ ID NO: 2119 - RNA, 20 nt, Artificial Sequence
  synthesized
gacccuaaggagaagaacaa

SEQ ID NO: 2120 - RNA, 20 nt, Artificial Sequence
  synthesized
guucuucuccuuagggucug

SEQ ID NO: 2121 - RNA, 20 nt, Artificial Sequence
  synthesized
ucuucuccuuagggucuggg

SEQ ID NO: 2122 - RNA, 20 nt, Artificial Sequence
  synthesized
uucuucuccuuagggucugg

SEQ ID NO: 2123 - RNA, 20 nt, Artificial Sequence
  synthesized
accuggaggccacucuaccu

SEQ ID NO: 2124 - RNA, 20 nt, Artificial Sequence
  synthesized
accugggggccacucuaccu

SEQ ID NO: 2125 - RNA, 20 nt, Artificial Sequence
  synthesized
agaguggcccccaggugacc

SEQ ID NO: 2126 - RNA, 20 nt, Artificial Sequence
  synthesized
agaguggccuccaggugacc

SEQ ID NO: 2127 - RNA, 20 nt, Artificial Sequence
  synthesized
aggcagugaggucaccugga

SEQ ID NO: 2128 - RNA, 20 nt, Artificial Sequence
  synthesized
aggcagugaggucaccuggg

SEQ ID NO: 2129 - RNA, 20 nt, Artificial Sequence
  synthesized
aggccacucuaccuggcugg

SEQ ID NO: 2130 - RNA, 20 nt, Artificial Sequence
  synthesized
agguagaguggcccccaggu

SEQ ID NO: 2131 - RNA, 20 nt, Artificial Sequence
  synthesized
aggucaccuggaggccacuc

SEQ ID NO: 2132 - RNA, 20 nt, Artificial Sequence
  synthesized
aggucaccugggggccacuc

SEQ ID NO: 2133 - RNA, 20 nt, Artificial Sequence
  synthesized
agugaggucaccuggaggcc

SEQ ID NO: 2134 - RNA, 20 nt, Artificial Sequence
  synthesized
agugaggucaccugggggcc

SEQ ID NO: 2135 - RNA, 20 nt, Artificial Sequence
  synthesized
aguggcccccaggugaccuc

SEQ ID NO: 2136 - RNA, 20 nt, Artificial Sequence
  synthesized
aguggccuccaggugaccuc

SEQ ID NO: 2137 - RNA, 20 nt, Artificial Sequence
  synthesized
cagccagguagaguggcccc

SEQ ID NO: 2138 - RNA, 20 nt, Artificial Sequence
  synthesized
cagccagguagaguggccuc

SEQ ID NO: 2139 - RNA, 20 nt, Artificial Sequence
  synthesized
cagugaggucaccuggaggc

SEQ ID NO: 2140 - RNA, 20 nt, Artificial Sequence
  synthesized
cagugaggucaccugggggc

SEQ ID NO: 2141 - RNA, 20 nt, Artificial Sequence
  synthesized
ccagccagguagaguggccu

SEQ ID NO: 2142 - RNA, 20 nt, Artificial Sequence
  synthesized
ccagguagaguggcccccag

SEQ ID NO: 2143 - RNA, 20 nt, Artificial Sequence
  synthesized
ccagguagaguggccuccag

SEQ ID NO: 2144 - RNA, 20 nt, Artificial Sequence
  synthesized
ccuccaggugaccucacugc

SEQ ID NO: 2145 - RNA, 20 nt, Artificial Sequence
  synthesized
ccuggaggccacucuaccug

SEQ ID NO: 2146 - RNA, 20 nt, Artificial Sequence
  synthesized
ccugggggccacucuaccug

SEQ ID NO: 2147 - RNA, 20 nt, Artificial Sequence
  synthesized
cuggaggccacucuaccugg

SEQ ID NO: 2148 - RNA, 20 nt, Artificial Sequence
  synthesized
gaggccacucuaccuggcug

SEQ ID NO: 2149 - RNA, 20 nt, Artificial Sequence
  synthesized
gaggucaccuggaggccacu

SEQ ID NO: 2150 - RNA, 20 nt, Artificial Sequence
  synthesized
gaggucaccugggggccacu

SEQ ID NO: 2151 - RNA, 20 nt, Artificial Sequence
  synthesized
gaguggcccccaggugaccu

SEQ ID NO: 2152 - RNA, 20 nt, Artificial Sequence
  synthesized
gaguggccuccaggugaccu

SEQ ID NO: 2153 - RNA, 20 nt, Artificial Sequence
  synthesized
gcagugaggucaccuggagg

SEQ ID NO: 2154 - RNA, 20 nt, Artificial Sequence
  synthesized
gcagugaggucaccuggggg

SEQ ID NO: 2155 - RNA, 20 nt, Artificial Sequence
  synthesized
gcccagccagguagaguggc

SEQ ID NO: 2156 - RNA, 20 nt, Artificial Sequence
  synthesized
gccuccaggugaccucacug

SEQ ID NO: 2157 - RNA, 20 nt, Artificial Sequence
  synthesized
ggcagugaggucaccuggag

SEQ ID NO: 2158 - RNA, 20 nt, Artificial Sequence
  synthesized
ggcagugaggucaccugggg

SEQ ID NO: 2159 - RNA, 20 nt, Artificial Sequence
  synthesized
ggcccccaggugaccucacu

SEQ ID NO: 2160 - RNA, 20 nt, Artificial Sequence
  synthesized
ggccuccaggugaccucacu

SEQ ID NO: 2161 - RNA, 20 nt, Artificial Sequence
  synthesized
ggggccacucuaccuggcug

SEQ ID NO: 2162 - RNA, 20 nt, Artificial Sequence
  synthesized
gguagaguggcccccaggug

SEQ ID NO: 2163 - RNA, 20 nt, Artificial Sequence
  synthesized
gguagaguggccuccaggug

SEQ ID NO: 2164 - RNA, 20 nt, Artificial Sequence
  synthesized
ggucaccugggggccacucu

SEQ ID NO: 2165 - RNA, 20 nt, Artificial Sequence
  synthesized
guagaguggcccccagguga

SEQ ID NO: 2166 - RNA, 20 nt, Artificial Sequence
  synthesized
guagaguggccuccagguga

SEQ ID NO: 2167 - RNA, 20 nt, Artificial Sequence
  synthesized
gucaccugggggccacucua

SEQ ID NO: 2168 - RNA, 20 nt, Artificial Sequence
  synthesized
gugaggucaccuggaggcca

SEQ ID NO: 2169 - RNA, 20 nt, Artificial Sequence
  synthesized
gugaggucaccugggggcca

SEQ ID NO: 2170 - RNA, 20 nt, Artificial Sequence
  synthesized
guggcccccaggugaccuca

SEQ ID NO: 2171 - RNA, 20 nt, Artificial Sequence
  synthesized
guggccuccaggugaccuca

SEQ ID NO: 2172 - RNA, 20 nt, Artificial Sequence
  synthesized
uagaguggcccccaggugac

SEQ ID NO: 2173 - RNA, 20 nt, Artificial Sequence
  synthesized
uagaguggccuccaggugac

SEQ ID NO: 2174 - RNA, 20 nt, Artificial Sequence
  synthesized
ucaccuggaggccacucuac

SEQ ID NO: 2175 - RNA, 20 nt, Artificial Sequence
  synthesized
ucaccugggggccacucuac

SEQ ID NO: 2176 - RNA, 20 nt, Artificial Sequence
  synthesized
uccaggugaccucacugccu

SEQ ID NO: 2177 - RNA, 20 nt, Artificial Sequence
  synthesized
ugaggucaccuggaggccac

SEQ ID NO: 2178 - RNA, 20 nt, Artificial Sequence
  synthesized
ugaggucaccugggggccac

SEQ ID NO: 2179 - RNA, 20 nt, Artificial Sequence
  synthesized
uggcccccaggugaccucac

SEQ ID NO: 2180 - RNA, 20 nt, Artificial Sequence
  synthesized
uggccuccaggugaccucac

SEQ ID NO: 2181 - RNA, 20 nt, Artificial Sequence
  synthesized
acccuaaggagaaacacaaa

SEQ ID NO: 2182 - RNA, 20 nt, Artificial Sequence
  synthesized
agacccuaaggagaaacaca

SEQ ID NO: 2183 - RNA, 20 nt, Artificial Sequence
  synthesized
cagacccuaaggagaaacac

SEQ ID NO: 2184 - RNA, 20 nt, Artificial Sequence
  synthesized
ccagacccuaaggagaaaca

SEQ ID NO: 2185 - RNA, 20 nt, Artificial Sequence
  synthesized
cccagacccuaaggagaaac

SEQ ID NO: 2186 - RNA, 20 nt, Artificial Sequence
  synthesized
cccuaaggagaaacacaaaa

SEQ ID NO: 2187 - RNA, 20 nt, Artificial Sequence
  synthesized
ccuaaggagaaacacaaaaa

SEQ ID NO: 2188 - RNA, 20 nt, Artificial Sequence
  synthesized
gacccuaaggagaaacacaa

SEQ ID NO: 2189 - RNA, 20 nt, Artificial Sequence
  synthesized
gcccagacccuaaggagaaa

SEQ ID NO: 2190 - RNA, 20 nt, Artificial Sequence
  synthesized
guguuucuccuuagggucug

SEQ ID NO: 2191 - RNA, 20 nt, Artificial Sequence
  synthesized
guuucuccuuagggucuggg

SEQ ID NO: 2192 - RNA, 20 nt, Artificial Sequence
  synthesized
uguuucuccuuagggucugg

SEQ ID NO: 2193 - RNA, 20 nt, Artificial Sequence
  synthesized
uuucuccuuagggucugggc

SEQ ID NO: 2194 - RNA, 20 nt, Artificial Sequence
  synthesized
aagagaguagaaauuuggag

SEQ ID NO: 2195 - RNA, 20 nt, Artificial Sequence
  synthesized
aagcccaggagcuccaaauu

SEQ ID NO: 2196 - RNA, 20 nt, Artificial Sequence
  synthesized
aagcccaggagcucuaaauu

SEQ ID NO: 2197 - RNA, 20 nt, Artificial Sequence
  synthesized
aauuuagagcuccugggcuu

SEQ ID NO: 2198 - RNA, 20 nt, Artificial Sequence
  synthesized
aauuuggagcuccugggcuu

SEQ ID NO: 2199 - RNA, 20 nt, Artificial Sequence
  synthesized
accugaagcccaggagcucc

SEQ ID NO: 2200 - RNA, 20 nt, Artificial Sequence
  synthesized
accugaagcccaggagcucu

SEQ ID NO: 2201 - RNA, 20 nt, Artificial Sequence
  synthesized
agaaauuuagagcuccuggg

SEQ ID NO: 2202 - RNA, 20 nt, Artificial Sequence
  synthesized
agagaguagaaauuuagagc

SEQ ID NO: 2203 - RNA, 20 nt, Artificial Sequence
  synthesized
agagaguagaaauuuggagc

SEQ ID NO: 2204 - RNA, 20 nt, Artificial Sequence
  synthesized
agagcuccugggcuucaggu

SEQ ID NO: 2205 - RNA, 20 nt, Artificial Sequence
  synthesized
agaguagaaauuuagagcuc

SEQ ID NO: 2206 - RNA, 20 nt, Artificial Sequence
  synthesized
agaguagaaauuuggagcuc

SEQ ID NO: 2207 - RNA, 20 nt, Artificial Sequence
  synthesized
agcccaggagcuccaaauuu

SEQ ID NO: 2208 - RNA, 20 nt, Artificial Sequence
  synthesized
agcccaggagcucuaaauuu

SEQ ID NO: 2209 - RNA, 20 nt, Artificial Sequence
  synthesized
aggagcuccaaauuucuacu

SEQ ID NO: 2210 - RNA, 20 nt, Artificial Sequence
  synthesized
aggagcucuaaauuucuacu

SEQ ID NO: 2211 - RNA, 20 nt, Artificial Sequence
  synthesized
caggagcuccaaauuucuac

SEQ ID NO: 2212 - RNA, 20 nt, Artificial Sequence
  synthesized
caggagcucuaaauuucuac

SEQ ID NO: 2213 - RNA, 20 nt, Artificial Sequence
  synthesized
ccaaauuucuacucucuuga

SEQ ID NO: 2214 - RNA, 20 nt, Artificial Sequence
  synthesized
ccaggagcuccaaauuucua

SEQ ID NO: 2215 - RNA, 20 nt, Artificial Sequence
  synthesized
ccaggagcucuaaauuucua

SEQ ID NO: 2216 - RNA, 20 nt, Artificial Sequence
  synthesized
cccaggagcuccaaauuucu

SEQ ID NO: 2217 - RNA, 20 nt, Artificial Sequence
  synthesized
cccaggagcucuaaauuucu

SEQ ID NO: 2218 - RNA, 20 nt, Artificial Sequence
  synthesized
ccugaagcccaggagcucca

SEQ ID NO: 2219 - RNA, 20 nt, Artificial Sequence
  synthesized
ccugaagcccaggagcucua

SEQ ID NO: 2220 - RNA, 20 nt, Artificial Sequence
  synthesized
cuccaaauuucuacucucuu

SEQ ID NO: 2221 - RNA, 20 nt, Artificial Sequence
  synthesized
cugaagcccaggagcuccaa

SEQ ID NO: 2222 - RNA, 20 nt, Artificial Sequence
  synthesized
cugaagcccaggagcucuaa

SEQ ID NO: 2223 - RNA, 20 nt, Artificial Sequence
  synthesized
gaaauuuagagcuccugggc

SEQ ID NO: 2224 - RNA, 20 nt, Artificial Sequence
  synthesized
gaaauuuggagcuccugggc

SEQ ID NO: 2225 - RNA, 20 nt, Artificial Sequence
  synthesized
gaagcccaggagcucuaaau

SEQ ID NO: 2226 - RNA, 20 nt, Artificial Sequence
  synthesized
gagaguagaaauuuagagcu

SEQ ID NO: 2227 - RNA, 20 nt, Artificial Sequence
  synthesized
gagaguagaaauuuggagcu

SEQ ID NO: 2228 - RNA, 20 nt, Artificial Sequence
  synthesized
gagcucuaaauuucuacucu

SEQ ID NO: 2229 - RNA, 20 nt, Artificial Sequence
  synthesized
gcccaggagcuccaaauuuc

SEQ ID NO: 2230 - RNA, 20 nt, Artificial Sequence
  synthesized
gcccaggagcucuaaauuuc

SEQ ID NO: 2231 - RNA, 20 nt, Artificial Sequence
  synthesized
ggagcuccugggcuucaggu

SEQ ID NO: 2232 - RNA, 20 nt, Artificial Sequence
  synthesized
guagaaauuuagagcuccug

SEQ ID NO: 2233 - RNA, 20 nt, Artificial Sequence
  synthesized
guagaaauuuggagcuccug

SEQ ID NO: 2234 - RNA, 20 nt, Artificial Sequence
  synthesized
uagaaauuuagagcuccugg

SEQ ID NO: 2235 - RNA, 20 nt, Artificial Sequence
  synthesized
uagaaauuuggagcuccugg

SEQ ID NO: 2236 - RNA, 20 nt, Artificial Sequence
  synthesized
uagagcuccugggcuucagg

SEQ ID NO: 2237 - RNA, 20 nt, Artificial Sequence
  synthesized
uccaaauuucuacucucuug

SEQ ID NO: 2238 - RNA, 20 nt, Artificial Sequence
  synthesized
ugaagcccaggagcuccaaa

SEQ ID NO: 2239 - RNA, 20 nt, Artificial Sequence
  synthesized
ugaagcccaggagcucuaaa

SEQ ID NO: 2240 - RNA, 20 nt, Artificial Sequence
  synthesized
uggagcuccugggcuucagg

SEQ ID NO: 2241 - RNA, 20 nt, Artificial Sequence
  synthesized
uuagagcuccugggcuucag

SEQ ID NO: 2242 - RNA, 20 nt, Artificial Sequence
  synthesized
uuggagcuccugggcuucag

SEQ ID NO: 2243 - RNA, 20 nt, Artificial Sequence
  synthesized
uuuagagcuccugggcuuca

SEQ ID NO: 2244 - RNA, 20 nt, Artificial Sequence
  synthesized
uuuggagcuccugggcuuca

SEQ ID NO: 2245 - RNA, 20 nt, Artificial Sequence
  synthesized
accccuccccccuccacugg

SEQ ID NO: 2246 - RNA, 20 nt, Artificial Sequence
  synthesized
acugcaccccuccccccucc

SEQ ID NO: 2247 - RNA, 20 nt, Artificial Sequence
  synthesized
acuggacaccuccaauccuc

SEQ ID NO: 2248 - RNA, 20 nt, Artificial Sequence
  synthesized
aggauuggagguguccaaug

SEQ ID NO: 2249 - RNA, 20 nt, Artificial Sequence
  synthesized
auggaggggggaggggugca

SEQ ID NO: 2250 - RNA, 20 nt, Artificial Sequence
  synthesized
caauggaggggggaggggug

SEQ ID NO: 2251 - RNA, 20 nt, Artificial Sequence
  synthesized
caccccuccccccuccauug

SEQ ID NO: 2252 - RNA, 20 nt, Artificial Sequence
  synthesized
cacuggacaccuccaauccu

SEQ ID NO: 2253 - RNA, 20 nt, Artificial Sequence
  synthesized
cauuggacaccuccaauccu

SEQ ID NO: 2254 - RNA, 20 nt, Artificial Sequence
  synthesized
ccaagaggauuggagguguc

SEQ ID NO: 2255 - RNA, 20 nt, Artificial Sequence
  synthesized
ccaauggaggggggaggggu

SEQ ID NO: 2256 - RNA, 20 nt, Artificial Sequence
  synthesized
ccacuggacaccuccaaucc

SEQ ID NO: 2257 - RNA, 20 nt, Artificial Sequence
  synthesized
ccauuggacaccuccaaucc

SEQ ID NO: 2258 - RNA, 20 nt, Artificial Sequence
  synthesized
ccccccuccacuggacaccu

SEQ ID NO: 2259 - RNA, 20 nt, Artificial Sequence
  synthesized
ccccccuccauuggacaccu

SEQ ID NO: 2260 - RNA, 20 nt, Artificial Sequence
  synthesized
cccccuccacuggacaccuc

SEQ ID NO: 2261 - RNA, 20 nt, Artificial Sequence
  synthesized
cccccuccauuggacaccuc

SEQ ID NO: 2262 - RNA, 20 nt, Artificial Sequence
  synthesized
ccccuccauuggacaccucc

SEQ ID NO: 2263 - RNA, 20 nt, Artificial Sequence
  synthesized
ccccuccccccuccacugga

SEQ ID NO: 2264 - RNA, 20 nt, Artificial Sequence
  synthesized
ccccuccccccuccauugga

SEQ ID NO: 2265 - RNA, 20 nt, Artificial Sequence
  synthesized
cccuccacuggacaccucca

SEQ ID NO: 2266 - RNA, 20 nt, Artificial Sequence
  synthesized
cccuccauuggacaccucca

SEQ ID NO: 2267 - RNA, 20 nt, Artificial Sequence
  synthesized
cccuccccccuccacuggac

SEQ ID NO: 2268 - RNA, 20 nt, Artificial Sequence
  synthesized
cccuccccccuccauuggac

SEQ ID NO: 2269 - RNA, 20 nt, Artificial Sequence
  synthesized
ccuccauuggacaccuccaa

SEQ ID NO: 2270 - RNA, 20 nt, Artificial Sequence
  synthesized
ccuccccccuccacuggaca

SEQ ID NO: 2271 - RNA, 20 nt, Artificial Sequence
  synthesized
ccuccccccuccauuggaca

SEQ ID NO: 2272 - RNA, 20 nt, Artificial Sequence
  synthesized
cuccacuggacaccuccaau

SEQ ID NO: 2273 - RNA, 20 nt, Artificial Sequence
  synthesized
cuccauuggacaccuccaau

SEQ ID NO: 2274 - RNA, 20 nt, Artificial Sequence
  synthesized
cuccccccuccacuggacac

SEQ ID NO: 2275 - RNA, 20 nt, Artificial Sequence
  synthesized
cuccccccuccauuggacac

SEQ ID NO: 2276 - RNA, 20 nt, Artificial Sequence
  synthesized
gagguguccaauggaggggg

SEQ ID NO: 2277 - RNA, 20 nt, Artificial Sequence
  synthesized
gagguguccaguggaggggg

SEQ ID NO: 2278 - RNA, 20 nt, Artificial Sequence
  synthesized
guccaauggaggggggaggg

SEQ ID NO: 2279 - RNA, 20 nt, Artificial Sequence
  synthesized
ucacugcaccccuccccccu

SEQ ID NO: 2280 - RNA, 20 nt, Artificial Sequence
  synthesized
uccaauggaggggggagggg

SEQ ID NO: 2281 - RNA, 20 nt, Artificial Sequence
  synthesized
uccacuggacaccuccaauc

SEQ ID NO: 2282 - RNA, 20 nt, Artificial Sequence
  synthesized
uccaguggaggggggagggg

SEQ ID NO: 2283 - RNA, 20 nt, Artificial Sequence
  synthesized
uccauuggacaccuccaauc

SEQ ID NO: 2284 - RNA, 20 nt, Artificial Sequence
  synthesized
aaugcugaggggcagggaca

SEQ ID NO: 2285 - RNA, 20 nt, Artificial Sequence
  synthesized
agagccucugucccugcccc

SEQ ID NO: 2286 - RNA, 20 nt, Artificial Sequence
  synthesized
agggacagaggcucugacca

SEQ ID NO: 2287 - RNA, 20 nt, Artificial Sequence
  synthesized
agggccagaggcucugacca

SEQ ID NO: 2288 - RNA, 20 nt, Artificial Sequence
  synthesized
ccucugucccugccccucag

SEQ ID NO: 2289 - RNA, 20 nt, Artificial Sequence
  synthesized
ccuggucagagccucuggcc

SEQ ID NO: 2290 - RNA, 20 nt, Artificial Sequence
  synthesized
ccuggucagagccucugucc

SEQ ID NO: 2291 - RNA, 20 nt, Artificial Sequence
  synthesized
cucugucccugccccucagc

SEQ ID NO: 2292 - RNA, 20 nt, Artificial Sequence
  synthesized
cugaggggcagggacagagg

SEQ ID NO: 2293 - RNA, 20 nt, Artificial Sequence
  synthesized
cuggucagagccucuggccc

SEQ ID NO: 2294 - RNA, 20 nt, Artificial Sequence
  synthesized
cuggucagagccucuguccc

SEQ ID NO: 2295 - RNA, 20 nt, Artificial Sequence
  synthesized
gaaaugcugaggggcaggga

SEQ ID NO: 2296 - RNA, 20 nt, Artificial Sequence
  synthesized
gaaaugcugaggggcagggc

SEQ ID NO: 2297 - RNA, 20 nt, Artificial Sequence
  synthesized
gagccucuggcccugccccu

SEQ ID NO: 2298 - RNA, 20 nt, Artificial Sequence
  synthesized
gagccucugucccugccccu

SEQ ID NO: 2299 - RNA, 20 nt, Artificial Sequence
  synthesized
gaggggcagggacagaggcu

SEQ ID NO: 2300 - RNA, 20 nt, Artificial Sequence
  synthesized
gaggggcagggccagaggcu

SEQ ID NO: 2301 - RNA, 20 nt, Artificial Sequence
  synthesized
gcagggacagaggcucugac

SEQ ID NO: 2302 - RNA, 20 nt, Artificial Sequence
  synthesized
gcagggccagaggcucugac

SEQ ID NO: 2303 - RNA, 20 nt, Artificial Sequence
  synthesized
gcccugccccucagcauuuc

SEQ ID NO: 2304 - RNA, 20 nt, Artificial Sequence
  synthesized
gccucugucccugccccuca

SEQ ID NO: 2305 - RNA, 20 nt, Artificial Sequence
  synthesized
gccuggucagagccucuggc

SEQ ID NO: 2306 - RNA, 20 nt, Artificial Sequence
  synthesized
gccuggucagagccucuguc

SEQ ID NO: 2307 - RNA, 20 nt, Artificial Sequence
  synthesized
gcugaggggcagggacagag

SEQ ID NO: 2308 - RNA, 20 nt, Artificial Sequence
  synthesized
gcugaggggcagggccagag

SEQ ID NO: 2309 - RNA, 20 nt, Artificial Sequence
  synthesized
ggaaaugcugaggggcaggg

SEQ ID NO: 2310 - RNA, 20 nt, Artificial Sequence
  synthesized
ggacagaggcucugaccagg

SEQ ID NO: 2311 - RNA, 20 nt, Artificial Sequence
  synthesized
ggccagaggcucugaccagg

SEQ ID NO: 2312 - RNA, 20 nt, Artificial Sequence
  synthesized
ggcccugccccucagcauuu

SEQ ID NO: 2313 - RNA, 20 nt, Artificial Sequence
  synthesized
ggccuggucagagccucugg

SEQ ID NO: 2314 - RNA, 20 nt, Artificial Sequence
  synthesized
ggccuggucagagccucugu

SEQ ID NO: 2315 - RNA, 20 nt, Artificial Sequence
  synthesized
gggacagaggcucugaccag

SEQ ID NO: 2316 - RNA, 20 nt, Artificial Sequence
  synthesized
gggcagggacagaggcucug

SEQ ID NO: 2317 - RNA, 20 nt, Artificial Sequence
  synthesized
gggcagggccagaggcucug

SEQ ID NO: 2318 - RNA, 20 nt, Artificial Sequence
  synthesized
gggccagaggcucugaccag

SEQ ID NO: 2319 - RNA, 20 nt, Artificial Sequence
  synthesized
ggggcagggacagaggcucu

SEQ ID NO: 2320 - RNA, 20 nt, Artificial Sequence
  synthesized
ggggcagggccagaggcucu

SEQ ID NO: 2321 - RNA, 20 nt, Artificial Sequence
  synthesized
ggucagagccucuggcccug

SEQ ID NO: 2322 - RNA, 20 nt, Artificial Sequence
  synthesized
ggucagagccucugucccug

SEQ ID NO: 2323 - RNA, 20 nt, Artificial Sequence
  synthesized
gucagagccucuggcccugc

SEQ ID NO: 2324 - RNA, 20 nt, Artificial Sequence
  synthesized
gucagagccucugucccugc

SEQ ID NO: 2325 - RNA, 20 nt, Artificial Sequence
  synthesized
gucccugccccucagcauuu

SEQ ID NO: 2326 - RNA, 20 nt, Artificial Sequence
  synthesized
ucagagccucuggcccugcc

SEQ ID NO: 2327 - RNA, 20 nt, Artificial Sequence
  synthesized
ucagagccucugucccugcc

SEQ ID NO: 2328 - RNA, 20 nt, Artificial Sequence
  synthesized
ucccugccccucagcauuuc

SEQ ID NO: 2329 - RNA, 20 nt, Artificial Sequence
  synthesized
ucuggcccugccccucagca

SEQ ID NO: 2330 - RNA, 20 nt, Artificial Sequence
  synthesized
ucugucccugccccucagca

SEQ ID NO: 2331 - RNA, 20 nt, Artificial Sequence
  synthesized
uggucagagccucuggcccu

SEQ ID NO: 2332 - RNA, 20 nt, Artificial Sequence
  synthesized
uggucagagccucugucccu

SEQ ID NO: 2333 - RNA, 20 nt, Artificial Sequence
  synthesized
acacaguccucccaccucag

SEQ ID NO: 2334 - RNA, 20 nt, Artificial Sequence
  synthesized
caaccuccugggcucacaca

SEQ ID NO: 2335 - RNA, 20 nt, Artificial Sequence
  synthesized
gaggcugaggugggaggacu

SEQ ID NO: 2336 - RNA, 20 nt, Artificial Sequence
  synthesized
ggacugugugagcccaggag

SEQ ID NO: 2337 - RNA, 20 nt, Artificial Sequence
  synthesized
guccucccaccucagccucc

SEQ ID NO: 2338 - RNA, 20 nt, Artificial Sequence
  synthesized
uccugggcucacacaguccu

SEQ ID NO: 2339 - RNA, 20 nt, Artificial Sequence
  synthesized
ugaggugggaggacugugug

SEQ ID NO: 2340 - RNA, 20 nt, Artificial Sequence
  synthesized
acccaucuguccauggaccc

SEQ ID NO: 2341 - RNA, 20 nt, Artificial Sequence
  synthesized
acccaucuguccguggaccc

SEQ ID NO: 2342 - RNA, 20 nt, Artificial Sequence
  synthesized
acggacagauggguaauaua

SEQ ID NO: 2343 - RNA, 20 nt, Artificial Sequence
  synthesized
aggguccacggacagauggg

SEQ ID NO: 2344 - RNA, 20 nt, Artificial Sequence
  synthesized
aggguccauggacagauggg

SEQ ID NO: 2345 - RNA, 20 nt, Artificial Sequence
  synthesized
auauuacccaucuguccaug

SEQ ID NO: 2346 - RNA, 20 nt, Artificial Sequence
  synthesized
auauuacccaucuguccgug

SEQ ID NO: 2347 - RNA, 20 nt, Artificial Sequence
  synthesized
auggacagauggguaauaua

SEQ ID NO: 2348 - RNA, 20 nt, Artificial Sequence
  synthesized
auuacccaucuguccaugga

SEQ ID NO: 2349 - RNA, 20 nt, Artificial Sequence
  synthesized
auuacccaucuguccgugga

SEQ ID NO: 2350 - RNA, 20 nt, Artificial Sequence
  synthesized
ccacggacagauggguaaua

SEQ ID NO: 2351 - RNA, 20 nt, Artificial Sequence
  synthesized
ccaucuguccauggacccua

SEQ ID NO: 2352 - RNA, 20 nt, Artificial Sequence
  synthesized
ccaucuguccguggacccua

SEQ ID NO: 2353 - RNA, 20 nt, Artificial Sequence
  synthesized
ccauggacagauggguaaua

SEQ ID NO: 2354 - RNA, 20 nt, Artificial Sequence
  synthesized
ccauggacccuagaggaaaa

SEQ ID NO: 2355 - RNA, 20 nt, Artificial Sequence
  synthesized
ccguggacccuagaggaaaa

SEQ ID NO: 2356 - RNA, 20 nt, Artificial Sequence
  synthesized
cggacagauggguaauauag

SEQ ID NO: 2357 - RNA, 20 nt, Artificial Sequence
  synthesized
cuguccauggacccuagagg

SEQ ID NO: 2358 - RNA, 20 nt, Artificial Sequence
  synthesized
cuguccguggacccuagagg

SEQ ID NO: 2359 - RNA, 20 nt, Artificial Sequence
  synthesized
ggguccacggacagaugggu

SEQ ID NO: 2360 - RNA, 20 nt, Artificial Sequence
  synthesized
ggguccauggacagaugggu

SEQ ID NO: 2361 - RNA, 20 nt, Artificial Sequence
  synthesized
gguccacggacagaugggua

SEQ ID NO: 2362 - RNA, 20 nt, Artificial Sequence
  synthesized
gguccauggacagaugggua

SEQ ID NO: 2363 - RNA, 20 nt, Artificial Sequence
  synthesized
guccacggacagauggguaa

SEQ ID NO: 2364 - RNA, 20 nt, Artificial Sequence
  synthesized
guccauggacagauggguaa

SEQ ID NO: 2365 - RNA, 20 nt, Artificial Sequence
  synthesized
guccauggacccuagaggaa

SEQ ID NO: 2366 - RNA, 20 nt, Artificial Sequence
  synthesized
guccguggacccuagaggaa

SEQ ID NO: 2367 - RNA, 20 nt, Artificial Sequence
  synthesized
uacccaucuguccauggacc

SEQ ID NO: 2368 - RNA, 20 nt, Artificial Sequence
  synthesized
uacccaucuguccguggacc

SEQ ID NO: 2369 - RNA, 20 nt, Artificial Sequence
  synthesized
uaggguccacggacagaugg

SEQ ID NO: 2370 - RNA, 20 nt, Artificial Sequence
  synthesized
uauuacccaucuguccaugg

SEQ ID NO: 2371 - RNA, 20 nt, Artificial Sequence
  synthesized
uauuacccaucuguccgugg

SEQ ID NO: 2372 - RNA, 20 nt, Artificial Sequence
  synthesized
uccacggacagauggguaau

SEQ ID NO: 2373 - RNA, 20 nt, Artificial Sequence
  synthesized
uccauggacagauggguaau

SEQ ID NO: 2374 - RNA, 20 nt, Artificial Sequence
  synthesized
uccauggacccuagaggaaa

SEQ ID NO: 2375 - RNA, 20 nt, Artificial Sequence
  synthesized
uccguggacccuagaggaaa

SEQ ID NO: 2376 - RNA, 20 nt, Artificial Sequence
  synthesized
uccucuaggguccacggaca

SEQ ID NO: 2377 - RNA, 20 nt, Artificial Sequence
  synthesized
uccucuaggguccauggaca

SEQ ID NO: 2378 - RNA, 20 nt, Artificial Sequence
  synthesized
ucuguccauggacccuagag

SEQ ID NO: 2379 - RNA, 20 nt, Artificial Sequence
  synthesized
ucuguccguggacccuagag

SEQ ID NO: 2380 - RNA, 20 nt, Artificial Sequence
  synthesized
uggacagauggguaauauag

SEQ ID NO: 2381 - RNA, 20 nt, Artificial Sequence
  synthesized
uguccauggacccuagagga

SEQ ID NO: 2382 - RNA, 20 nt, Artificial Sequence
  synthesized
uguccguggacccuagagga

SEQ ID NO: 2383 - RNA, 20 nt, Artificial Sequence
  synthesized
uuacccaucuguccguggac

SEQ ID NO: 2384 - RNA, 20 nt, Artificial Sequence
  synthesized
uuuccucuaggguccacgga

SEQ ID NO: 2385 - RNA, 20 nt, Artificial Sequence
  synthesized
uuuccucuaggguccaugga

SEQ ID NO: 2386 - RNA, 20 nt, Artificial Sequence
  synthesized
aacaauaggugaaucugugu

SEQ ID NO: 2387 - RNA, 20 nt, Artificial Sequence
  synthesized
aaucuggguaaacagccugu

SEQ ID NO: 2388 - RNA, 20 nt, Artificial Sequence
  synthesized
aaucuguguaaacagccugu

SEQ ID NO: 2389 - RNA, 20 nt, Artificial Sequence
  synthesized
acacucacaggcuguuuaca

SEQ ID NO: 2390 - RNA, 20 nt, Artificial Sequence
  synthesized
acacucacaggcuguuuacc

SEQ ID NO: 2391 - RNA, 20 nt, Artificial Sequence
  synthesized
acaggcuguuuacacagauu

SEQ ID NO: 2392 - RNA, 20 nt, Artificial Sequence
  synthesized
acaggcuguuuacccagauu

SEQ ID NO: 2393 - RNA, 20 nt, Artificial Sequence
  synthesized
acucacaggcuguuuacaca

SEQ ID NO: 2394 - RNA, 20 nt, Artificial Sequence
  synthesized
acucacaggcuguuuaccca

SEQ ID NO: 2395 - RNA, 20 nt, Artificial Sequence
  synthesized
aggcuguuuacacagauuca

SEQ ID NO: 2396 - RNA, 20 nt, Artificial Sequence
  synthesized
aggcuguuuacccagauuca

SEQ ID NO: 2397 - RNA, 20 nt, Artificial Sequence
  synthesized
aggugaaucuggguaaacag

SEQ ID NO: 2398 - RNA, 20 nt, Artificial Sequence
  synthesized
aggugaaucuguguaaacag

SEQ ID NO: 2399 - RNA, 20 nt, Artificial Sequence
  synthesized
auaggugaaucuggguaaac

SEQ ID NO: 2400 - RNA, 20 nt, Artificial Sequence
  synthesized
auaggugaaucuguguaaac

SEQ ID NO: 2401 - RNA, 20 nt, Artificial Sequence
  synthesized
caauaggugaaucuguguaa

SEQ ID NO: 2402 - RNA, 20 nt, Artificial Sequence
  synthesized
cacaggcuguuuacacagau

SEQ ID NO: 2403 - RNA, 20 nt, Artificial Sequence
  synthesized
cacaggcuguuuacccagau

SEQ ID NO: 2404 - RNA, 20 nt, Artificial Sequence
  synthesized
caggcuguuuacacagauuc

SEQ ID NO: 2405 - RNA, 20 nt, Artificial Sequence
  synthesized
caggcuguuuacccagauuc

SEQ ID NO: 2406 - RNA, 20 nt, Artificial Sequence
  synthesized
cuggguaaacagccugugag

SEQ ID NO: 2407 - RNA, 20 nt, Artificial Sequence
  synthesized
cuguguaaacagccugugag

SEQ ID NO: 2408 - RNA, 20 nt, Artificial Sequence
  synthesized
cuguuuacacagauucaccu

SEQ ID NO: 2409 - RNA, 20 nt, Artificial Sequence
  synthesized
gcuaacaauaggugaaucug

SEQ ID NO: 2410 - RNA, 20 nt, Artificial Sequence
  synthesized
gcuguuuacacagauucacc

SEQ ID NO: 2411 - RNA, 20 nt, Artificial Sequence
  synthesized
ggcuguuuacacagauucac

SEQ ID NO: 2412 - RNA, 20 nt, Artificial Sequence
  synthesized
ggcuguuuacccagauucac

SEQ ID NO: 2413 - RNA, 20 nt, Artificial Sequence
  synthesized
ggguaaacagccugugagug

SEQ ID NO: 2414 - RNA, 20 nt, Artificial Sequence
  synthesized
gguaaacagccugugagugu

SEQ ID NO: 2415 - RNA, 20 nt, Artificial Sequence
  synthesized
ggugaaucuggguaaacagc

SEQ ID NO: 2416 - RNA, 20 nt, Artificial Sequence
  synthesized
ggugaaucuguguaaacagc

SEQ ID NO: 2417 - RNA, 20 nt, Artificial Sequence
  synthesized
guguaaacagccugugagug

SEQ ID NO: 2418 - RNA, 20 nt, Artificial Sequence
  synthesized
guuuacacagauucaccuau

SEQ ID NO: 2419 - RNA, 20 nt, Artificial Sequence
  synthesized
uacacagauucaccuauugu

SEQ ID NO: 2420 - RNA, 20 nt, Artificial Sequence
  synthesized
uaggugaaucuggguaaaca

SEQ ID NO: 2421 - RNA, 20 nt, Artificial Sequence
  synthesized
uaggugaaucuguguaaaca

SEQ ID NO: 2422 - RNA, 20 nt, Artificial Sequence
  synthesized
ucacaggcuguuuacacaga

SEQ ID NO: 2423 - RNA, 20 nt, Artificial Sequence
  synthesized
ucacaggcuguuuacccaga

SEQ ID NO: 2424 - RNA, 20 nt, Artificial Sequence
  synthesized
ucuggguaaacagccuguga

SEQ ID NO: 2425 - RNA, 20 nt, Artificial Sequence
  synthesized
ucuguguaaacagccuguga

SEQ ID NO: 2426 - RNA, 20 nt, Artificial Sequence
  synthesized
ugaaucuggguaaacagccu

SEQ ID NO: 2427 - RNA, 20 nt, Artificial Sequence
  synthesized
ugaaucuguguaaacagccu

SEQ ID NO: 2428 - RNA, 20 nt, Artificial Sequence
  synthesized
uggguaaacagccugugagu

SEQ ID NO: 2429 - RNA, 20 nt, Artificial Sequence
  synthesized
uguaaacagccugugagugu

SEQ ID NO: 2430 - RNA, 20 nt, Artificial Sequence
  synthesized
uguguaaacagccugugagu

SEQ ID NO: 2431 - RNA, 20 nt, Artificial Sequence
  synthesized
uguuuacacagauucaccua

SEQ ID NO: 2432 - RNA, 20 nt, Artificial Sequence
  synthesized
aaggggucacagggccgguc

SEQ ID NO: 2433 - RNA, 20 nt, Artificial Sequence
  synthesized
accccucaccgggggccgug

SEQ ID NO: 2434 - RNA, 20 nt, Artificial Sequence
  synthesized
accccuuaccgggggccgug

SEQ ID NO: 2435 - RNA, 20 nt, Artificial Sequence
  synthesized
accggcccugugaccccuca

SEQ ID NO: 2436 - RNA, 20 nt, Artificial Sequence
  synthesized
accggcccugugaccccuua

SEQ ID NO: 2437 - RNA, 20 nt, Artificial Sequence
  synthesized
acggcccccgguaagggguc

SEQ ID NO: 2438 - RNA, 20 nt, Artificial Sequence
  synthesized
acggcccccggugagggguc

SEQ ID NO: 2439 - RNA, 20 nt, Artificial Sequence
  synthesized
caccgggggccgugggcccg

SEQ ID NO: 2440 - RNA, 20 nt, Artificial Sequence
  synthesized
cacggcccccgguaaggggu

SEQ ID NO: 2441 - RNA, 20 nt, Artificial Sequence
  synthesized
cacggcccccggugaggggu

SEQ ID NO: 2442 - RNA, 20 nt, Artificial Sequence
  synthesized
ccacggcccccgguaagggg

SEQ ID NO: 2443 - RNA, 20 nt, Artificial Sequence
  synthesized
ccacggcccccggugagggg

SEQ ID NO: 2444 - RNA, 20 nt, Artificial Sequence
  synthesized
cccacggcccccgguaaggg

SEQ ID NO: 2445 - RNA, 20 nt, Artificial Sequence
  synthesized
cccacggcccccggugaggg

SEQ ID NO: 2446 - RNA, 20 nt, Artificial Sequence
  synthesized
cccccgguaaggggucacag

SEQ ID NO: 2447 - RNA, 20 nt, Artificial Sequence
  synthesized
cccccggugaggggucacag

SEQ ID NO: 2448 - RNA, 20 nt, Artificial Sequence
  synthesized
ccccucaccgggggccgugg

SEQ ID NO: 2449 - RNA, 20 nt, Artificial Sequence
  synthesized
ccccuuaccgggggccgugg

SEQ ID NO: 2450 - RNA, 20 nt, Artificial Sequence
  synthesized
cccgguaaggggucacaggg

SEQ ID NO: 2451 - RNA, 20 nt, Artificial Sequence
  synthesized
cccggugaggggucacaggg

SEQ ID NO: 2452 - RNA, 20 nt, Artificial Sequence
  synthesized
cccucaccgggggccguggg

SEQ ID NO: 2453 - RNA, 20 nt, Artificial Sequence
  synthesized
cccugugaccccucaccggg

SEQ ID NO: 2454 - RNA, 20 nt, Artificial Sequence
  synthesized
cccugugaccccuuaccggg

SEQ ID NO: 2455 - RNA, 20 nt, Artificial Sequence
  synthesized
cccuuaccgggggccguggg

SEQ ID NO: 2456 - RNA, 20 nt, Artificial Sequence
  synthesized
ccugugaccccucaccgggg

SEQ ID NO: 2457 - RNA, 20 nt, Artificial Sequence
  synthesized
ccugugaccccuuaccgggg

SEQ ID NO: 2458 - RNA, 20 nt, Artificial Sequence
  synthesized
cgguaaggggucacagggcc

SEQ ID NO: 2459 - RNA, 20 nt, Artificial Sequence
  synthesized
cggugaggggucacagggcc

SEQ ID NO: 2460 - RNA, 20 nt, Artificial Sequence
  synthesized
cugugaccccucaccggggg

SEQ ID NO: 2461 - RNA, 20 nt, Artificial Sequence
  synthesized
cugugaccccuuaccggggg

SEQ ID NO: 2462 - RNA, 20 nt, Artificial Sequence
  synthesized
gaccggcccugugaccccuc

SEQ ID NO: 2463 - RNA, 20 nt, Artificial Sequence
  synthesized
gaccggcccugugaccccuu

SEQ ID NO: 2464 - RNA, 20 nt, Artificial Sequence
  synthesized
gaggggucacagggccgguc

SEQ ID NO: 2465 - RNA, 20 nt, Artificial Sequence
  synthesized
gguaaggggucacagggccg

SEQ ID NO: 2466 - RNA, 20 nt, Artificial Sequence
  synthesized
ggugaggggucacagggccg

SEQ ID NO: 2467 - RNA, 20 nt, Artificial Sequence
  synthesized
guaaggggucacagggccgg

SEQ ID NO: 2468 - RNA, 20 nt, Artificial Sequence
  synthesized
gugaggggucacagggccgg

SEQ ID NO: 2469 - RNA, 20 nt, Artificial Sequence
  synthesized
uaaggggucacagggccggu

SEQ ID NO: 2470 - RNA, 20 nt, Artificial Sequence
  synthesized
uaccgggggccgugggcccg

SEQ ID NO: 2471 - RNA, 20 nt, Artificial Sequence
  synthesized
ucaccgggggccgugggccc

SEQ ID NO: 2472 - RNA, 20 nt, Artificial Sequence
  synthesized
ugaggggucacagggccggu

SEQ ID NO: 2473 - RNA, 20 nt, Artificial Sequence
  synthesized
uuaccgggggccgugggccc

SEQ ID NO: 2474 - RNA, 20 nt, Artificial Sequence
  synthesized
aaggugcuaccggagccuuc

SEQ ID NO: 2475 - RNA, 20 nt, Artificial Sequence
  synthesized
acccuccgcucuggaaggcu

SEQ ID NO: 2476 - RNA, 20 nt, Artificial Sequence
  synthesized
ccgcucuggaaggcuccggu

SEQ ID NO: 2477 - RNA, 20 nt, Artificial Sequence
  synthesized
ccuuccagagcggaggguaa

SEQ ID NO: 2478 - RNA, 20 nt, Artificial Sequence
  synthesized
cgcucuggaaggcuccggua

SEQ ID NO: 2479 - RNA, 20 nt, Artificial Sequence
  synthesized
cggagccuuccagagcggag

SEQ ID NO: 2480 - RNA, 20 nt, Artificial Sequence
  synthesized
cuccgcucuggaaggcuccg

SEQ ID NO: 2481 - RNA, 20 nt, Artificial Sequence
  synthesized
cucuggaaggcuccgguagc

SEQ ID NO: 2482 - RNA, 20 nt, Artificial Sequence
  synthesized
cucugggaggcuccgguagc

SEQ ID NO: 2483 - RNA, 20 nt, Artificial Sequence
  synthesized
cuggaaggcuccgguagcac

SEQ ID NO: 2484 - RNA, 20 nt, Artificial Sequence
  synthesized
cugggaggcuccgguagcac

SEQ ID NO: 2485 - RNA, 20 nt, Artificial Sequence
  synthesized
cuuacccuccgcucuggaag

SEQ ID NO: 2486 - RNA, 20 nt, Artificial Sequence
  synthesized
cuuccagagcggaggguaag

SEQ ID NO: 2487 - RNA, 20 nt, Artificial Sequence
  synthesized
gaaggcuccgguagcaccuu

SEQ ID NO: 2488 - RNA, 20 nt, Artificial Sequence
  synthesized
gaaggugcuaccggagccuc

SEQ ID NO: 2489 - RNA, 20 nt, Artificial Sequence
  synthesized
gaaggugcuaccggagccuu

SEQ ID NO: 2490 - RNA, 20 nt, Artificial Sequence
  synthesized
gagccuuccagagcggaggg

SEQ ID NO: 2491 - RNA, 20 nt, Artificial Sequence
  synthesized
gcucuggaaggcuccgguag

SEQ ID NO: 2492 - RNA, 20 nt, Artificial Sequence
  synthesized
gcucugggaggcuccgguag

SEQ ID NO: 2493 - RNA, 20 nt, Artificial Sequence
  synthesized
ggaaggcuccgguagcaccu

SEQ ID NO: 2494 - RNA, 20 nt, Artificial Sequence
  synthesized
ggagccuuccagagcggagg

SEQ ID NO: 2495 - RNA, 20 nt, Artificial Sequence
  synthesized
ggaggcuccgguagcaccuu

SEQ ID NO: 2496 - RNA, 20 nt, Artificial Sequence
  synthesized
gggaggcuccgguagcaccu

SEQ ID NO: 2497 - RNA, 20 nt, Artificial Sequence
  synthesized
ggugcuaccggagccuccca

SEQ ID NO: 2498 - RNA, 20 nt, Artificial Sequence
  synthesized
ggugcuaccggagccuucca

SEQ ID NO: 2499 - RNA, 20 nt, Artificial Sequence
  synthesized
uccagagcggaggguaagag

SEQ ID NO: 2500 - RNA, 20 nt, Artificial Sequence
  synthesized
ucuggaaggcuccgguagca

SEQ ID NO: 2501 - RNA, 20 nt, Artificial Sequence
  synthesized
ucugggaggcuccgguagca

SEQ ID NO: 2502 - RNA, 20 nt, Artificial Sequence
  synthesized
ucuuacccuccgcucuggaa

SEQ ID NO: 2503 - RNA, 20 nt, Artificial Sequence
  synthesized
ugcuaccggagccuuccaga

SEQ ID NO: 2504 - RNA, 20 nt, Artificial Sequence
  synthesized
uggaaggcuccgguagcacc

SEQ ID NO: 2505 - RNA, 20 nt, Artificial Sequence
  synthesized
ugggaggcuccgguagcacc

SEQ ID NO: 2506 - RNA, 20 nt, Artificial Sequence
  synthesized
uuacccuccgcucuggaagg

SEQ ID NO: 2507 - RNA, 20 nt, Artificial Sequence
  synthesized
uuccagagcggaggguaaga

SEQ ID NO: 2508 - RNA, 20 nt, Artificial Sequence
  synthesized
aaagaagaagagagagagag

SEQ ID NO: 2509 - RNA, 20 nt, Artificial Sequence
  synthesized
agaagagagagagagagaga

SEQ ID NO: 2510 - RNA, 20 nt, Artificial Sequence
  synthesized
cucucucucucucucucucu

SEQ ID NO: 2511 - RNA, 20 nt, Artificial Sequence
  synthesized
cucucucucucucucuucuu

SEQ ID NO: 2512 - RNA, 20 nt, Artificial Sequence
  synthesized
guaugaaagaagaagagaga

SEQ ID NO: 2513 - RNA, 20 nt, Artificial Sequence
  synthesized
ucucucucucucucucucuc

SEQ ID NO: 2514 - RNA, 20 nt, Artificial Sequence
  synthesized
ucucucucucuucuucuuuc

SEQ ID NO: 2515 - RNA, 20 nt, Artificial Sequence
  synthesized
acucuaccuggcugggcugc

SEQ ID NO: 2516 - RNA, 20 nt, Artificial Sequence
  synthesized
agcugcagcccagccaggua

SEQ ID NO: 2517 - RNA, 20 nt, Artificial Sequence
  synthesized
cacucuaccuggcugggcug

SEQ ID NO: 2518 - RNA, 20 nt, Artificial Sequence
  synthesized
cagcccagccagguagagug

SEQ ID NO: 2519 - RNA, 20 nt, Artificial Sequence
  synthesized
ccacucuaccuggcugggcu

SEQ ID NO: 2520 - RNA, 20 nt, Artificial Sequence
  synthesized
ccuggcugggcugcagcugc

SEQ ID NO: 2521 - RNA, 20 nt, Artificial Sequence
  synthesized
cuaccuggcugggcugcagc

SEQ ID NO: 2522 - RNA, 20 nt, Artificial Sequence
  synthesized
cucuaccuggcugggcugca

SEQ ID NO: 2523 - RNA, 20 nt, Artificial Sequence
  synthesized
cugcagcccagccagguaga

SEQ ID NO: 2524 - RNA, 20 nt, Artificial Sequence
  synthesized
cugcagcugcccucccagcc

SEQ ID NO: 2525 - RNA, 20 nt, Artificial Sequence
  synthesized
cugggcugcagcugcccucc

SEQ ID NO: 2526 - RNA, 20 nt, Artificial Sequence
  synthesized
gagggcagcugcagcccagc

SEQ ID NO: 2527 - RNA, 20 nt, Artificial Sequence
  synthesized
gcagcccagccagguagagu

SEQ ID NO: 2528 - RNA, 20 nt, Artificial Sequence
  synthesized
gcugggagggcagcugcagc

SEQ ID NO: 2529 - RNA, 20 nt, Artificial Sequence
  synthesized
ggagcccagccagguagagu

SEQ ID NO: 2530 - RNA, 20 nt, Artificial Sequence
  synthesized
ggcagcugcagcccagccag

SEQ ID NO: 2531 - RNA, 20 nt, Artificial Sequence
  synthesized
ugggcugcagcugcccuccc

SEQ ID NO: 2532 - RNA, 20 nt, Artificial Sequence
  synthesized
aaaaauucuaaggagagagg

SEQ ID NO: 2533 - RNA, 20 nt, Artificial Sequence
  synthesized
aaauccucucuccuuagaau

SEQ ID NO: 2534 - RNA, 20 nt, Artificial Sequence
  synthesized
aaauucuaaggagagaggau

SEQ ID NO: 2535 - RNA, 20 nt, Artificial Sequence
  synthesized
aauccucucugcuuagaauu

SEQ ID NO: 2536 - RNA, 20 nt, Artificial Sequence
  synthesized
aauucuaagcagagaggauu

SEQ ID NO: 2537 - RNA, 20 nt, Artificial Sequence
  synthesized
aauucuaaggagagaggauu

SEQ ID NO: 2538 - RNA, 20 nt, Artificial Sequence
  synthesized
agaaaauccucucuccuuag

SEQ ID NO: 2539 - RNA, 20 nt, Artificial Sequence
  synthesized
agaaaauccucucugcuuag

SEQ ID NO: 2540 - RNA, 20 nt, Artificial Sequence
  synthesized
auccucucugcuuagaauuu

SEQ ID NO: 2541 - RNA, 20 nt, Artificial Sequence
  synthesized
auucuaagcagagaggauuu

SEQ ID NO: 2542 - RNA, 20 nt, Artificial Sequence
  synthesized
auucuaaggagagaggauuu

SEQ ID NO: 2543 - RNA, 20 nt, Artificial Sequence
  synthesized
cagaaaauccucucuccuua

SEQ ID NO: 2544 - RNA, 20 nt, Artificial Sequence
  synthesized
cagaaaauccucucugcuua

SEQ ID NO: 2545 - RNA, 20 nt, Artificial Sequence
  synthesized
gaaaauccucucuccuuaga

SEQ ID NO: 2546 - RNA, 20 nt, Artificial Sequence
  synthesized
ggacagaaaauccucucucc

SEQ ID NO: 2547 - RNA, 20 nt, Artificial Sequence
  synthesized
uggacagaaaauccucucuc

SEQ ID NO: 2548 - RNA, 20 nt, Artificial Sequence
  synthesized
uggacagaaaauccucucug

SEQ ID NO: 2549 - RNA, 20 nt, Artificial Sequence
  synthesized
aagcuguggaggugggggac

SEQ ID NO: 2550 - RNA, 20 nt, Artificial Sequence
  synthesized
aagcuguggcggugggggac

SEQ ID NO: 2551 - RNA, 20 nt, Artificial Sequence
  synthesized
accgccacagcuuaccgcau

SEQ ID NO: 2552 - RNA, 20 nt, Artificial Sequence
  synthesized
accuccacagcuuaccgcau

SEQ ID NO: 2553 - RNA, 20 nt, Artificial Sequence
  synthesized
acggcgucccccaccgccac

SEQ ID NO: 2554 - RNA, 20 nt, Artificial Sequence
  synthesized
acggcgucccccaccuccac

SEQ ID NO: 2555 - RNA, 20 nt, Artificial Sequence
  synthesized
agcuguggaggugggggacg

SEQ ID NO: 2556 - RNA, 20 nt, Artificial Sequence
  synthesized
agcuguggcggugggggacg

SEQ ID NO: 2557 - RNA, 20 nt, Artificial Sequence
  synthesized
aggugggggacgccgugagc

SEQ ID NO: 2558 - RNA, 20 nt, Artificial Sequence
  synthesized
caccgccacagcuuaccgca

SEQ ID NO: 2559 - RNA, 20 nt, Artificial Sequence
  synthesized
caccuccacagcuuaccgca

SEQ ID NO: 2560 - RNA, 20 nt, Artificial Sequence
  synthesized
cacggcgucccccaccgcca

SEQ ID NO: 2561 - RNA, 20 nt, Artificial Sequence
  synthesized
cacggcgucccccaccucca

SEQ ID NO: 2562 - RNA, 20 nt, Artificial Sequence
  synthesized
ccaccgccacagcuuaccgc

SEQ ID NO: 2563 - RNA, 20 nt, Artificial Sequence
  synthesized
ccaccuccacagcuuaccgc

SEQ ID NO: 2564 - RNA, 20 nt, Artificial Sequence
  synthesized
cccaccgccacagcuuaccg

SEQ ID NO: 2565 - RNA, 20 nt, Artificial Sequence
  synthesized
cccaccuccacagcuuaccg

SEQ ID NO: 2566 - RNA, 20 nt, Artificial Sequence
  synthesized
ccccaccgccacagcuuacc

SEQ ID NO: 2567 - RNA, 20 nt, Artificial Sequence
  synthesized
ccccaccuccacagcuuacc

SEQ ID NO: 2568 - RNA, 20 nt, Artificial Sequence
  synthesized
cccccaccgccacagcuuac

SEQ ID NO: 2569 - RNA, 20 nt, Artificial Sequence
  synthesized
cccccaccuccacagcuuac

SEQ ID NO: 2570 - RNA, 20 nt, Artificial Sequence
  synthesized
ccgccacagcuuaccgcauc

SEQ ID NO: 2571 - RNA, 20 nt, Artificial Sequence
  synthesized
ccuccacagcuuaccgcauc

SEQ ID NO: 2572 - RNA, 20 nt, Artificial Sequence
  synthesized
cgccacagcuuaccgcaucc

SEQ ID NO: 2573 - RNA, 20 nt, Artificial Sequence
  synthesized
cggcgucccccaccgccaca

SEQ ID NO: 2574 - RNA, 20 nt, Artificial Sequence
  synthesized
cggcgucccccaccuccaca

SEQ ID NO: 2575 - RNA, 20 nt, Artificial Sequence
  synthesized
cggugggggacgccgugagc

SEQ ID NO: 2576 - RNA, 20 nt, Artificial Sequence
  synthesized
cucacggcgucccccaccgc

SEQ ID NO: 2577 - RNA, 20 nt, Artificial Sequence
  synthesized
cucacggcgucccccaccuc

SEQ ID NO: 2578 - RNA, 20 nt, Artificial Sequence
  synthesized
cuccacagcuuaccgcaucc

SEQ ID NO: 2579 - RNA, 20 nt, Artificial Sequence
  synthesized
cuguggaggugggggacgcc

SEQ ID NO: 2580 - RNA, 20 nt, Artificial Sequence
  synthesized
cuguggcggugggggacgcc

SEQ ID NO: 2581 - RNA, 20 nt, Artificial Sequence
  synthesized
gaggugggggacgccgugag

SEQ ID NO: 2582 - RNA, 20 nt, Artificial Sequence
  synthesized
gcggugggggacgccgugag

SEQ ID NO: 2583 - RNA, 20 nt, Artificial Sequence
  synthesized
gcgucccccaccgccacagc

SEQ ID NO: 2584 - RNA, 20 nt, Artificial Sequence
  synthesized
gcgucccccaccuccacagc

SEQ ID NO: 2585 - RNA, 20 nt, Artificial Sequence
  synthesized
gcucacggcgucccccaccg

SEQ ID NO: 2586 - RNA, 20 nt, Artificial Sequence
  synthesized
gcucacggcgucccccaccu

SEQ ID NO: 2587 - RNA, 20 nt, Artificial Sequence
  synthesized
ggaggugggggacgccguga

SEQ ID NO: 2588 - RNA, 20 nt, Artificial Sequence
  synthesized
ggaugcgguaagcuguggag

SEQ ID NO: 2589 - RNA, 20 nt, Artificial Sequence
  synthesized
ggaugcgguaagcuguggcg

SEQ ID NO: 2590 - RNA, 20 nt, Artificial Sequence
  synthesized
ggcggugggggacgccguga

SEQ ID NO: 2591 - RNA, 20 nt, Artificial Sequence
  synthesized
ggcgucccccaccgccacag

SEQ ID NO: 2592 - RNA, 20 nt, Artificial Sequence
  synthesized
ggcgucccccaccuccacag

SEQ ID NO: 2593 - RNA, 20 nt, Artificial Sequence
  synthesized
gguaagcuguggaggugggg

SEQ ID NO: 2594 - RNA, 20 nt, Artificial Sequence
  synthesized
gguaagcuguggcggugggg

SEQ ID NO: 2595 - RNA, 20 nt, Artificial Sequence
  synthesized
guaagcuguggagguggggg

SEQ ID NO: 2596 - RNA, 20 nt, Artificial Sequence
  synthesized
guaagcuguggcgguggggg

SEQ ID NO: 2597 - RNA, 20 nt, Artificial Sequence
  synthesized
gucccccaccgccacagcuu

SEQ ID NO: 2598 - RNA, 20 nt, Artificial Sequence
  synthesized
gucccccaccuccacagcuu

SEQ ID NO: 2599 - RNA, 20 nt, Artificial Sequence
  synthesized
guggaggugggggacgccgu

SEQ ID NO: 2600 - RNA, 20 nt, Artificial Sequence
  synthesized
guggcggugggggacgccgu

SEQ ID NO: 2601 - RNA, 20 nt, Artificial Sequence
  synthesized
uaagcuguggagguggggga

SEQ ID NO: 2602 - RNA, 20 nt, Artificial Sequence
  synthesized
uaagcuguggcgguggggga

SEQ ID NO: 2603 - RNA, 20 nt, Artificial Sequence
  synthesized
ucacggcgucccccaccgcc

SEQ ID NO: 2604 - RNA, 20 nt, Artificial Sequence
  synthesized
ucacggcgucccccaccucc

SEQ ID NO: 2605 - RNA, 20 nt, Artificial Sequence
  synthesized
uggaggugggggacgccgug

SEQ ID NO: 2606 - RNA, 20 nt, Artificial Sequence
  synthesized
uggcggugggggacgccgug

SEQ ID NO: 2607 - RNA, 20 nt, Artificial Sequence
  synthesized
aagucccgcccccagcagcc

SEQ ID NO: 2608 - RNA, 20 nt, Artificial Sequence
  synthesized
acggggcugcugggggcggg

SEQ ID NO: 2609 - RNA, 20 nt, Artificial Sequence
  synthesized
agcucagguacaagucccgc

SEQ ID NO: 2610 - RNA, 20 nt, Artificial Sequence
  synthesized
agcucagguacaaguccugc

SEQ ID NO: 2611 - RNA, 20 nt, Artificial Sequence
  synthesized
aggacuuguaccugagcugc

SEQ ID NO: 2612 - RNA, 20 nt, Artificial Sequence
  synthesized
agguacaaguccugccccca

SEQ ID NO: 2613 - RNA, 20 nt, Artificial Sequence
  synthesized
agucccgcccccagcagccc

SEQ ID NO: 2614 - RNA, 20 nt, Artificial Sequence
  synthesized
aguccugcccccagcagccc

SEQ ID NO: 2615 - RNA, 20 nt, Artificial Sequence
  synthesized
caagucccgcccccagcagc

SEQ ID NO: 2616 - RNA, 20 nt, Artificial Sequence
  synthesized
caaguccugcccccagcagc

SEQ ID NO: 2617 - RNA, 20 nt, Artificial Sequence
  synthesized
cagcucagguacaagucccg

SEQ ID NO: 2618 - RNA, 20 nt, Artificial Sequence
  synthesized
cagcucagguacaaguccug

SEQ ID NO: 2619 - RNA, 20 nt, Artificial Sequence
  synthesized
caggcagcucagguacaagu

SEQ ID NO: 2620 - RNA, 20 nt, Artificial Sequence
  synthesized
cccgcccccagcagccccgu

SEQ ID NO: 2621 - RNA, 20 nt, Artificial Sequence
  synthesized
ccgcccccagcagccccguc

SEQ ID NO: 2622 - RNA, 20 nt, Artificial Sequence
  synthesized
ccugcccccagcagccccgu

SEQ ID NO: 2623 - RNA, 20 nt, Artificial Sequence
  synthesized
cgcccccagcagccccgucu

SEQ ID NO: 2624 - RNA, 20 nt, Artificial Sequence
  synthesized
cgggacuuguaccugagcug

SEQ ID NO: 2625 - RNA, 20 nt, Artificial Sequence
  synthesized
cggggcugcugggggcagga

SEQ ID NO: 2626 - RNA, 20 nt, Artificial Sequence
  synthesized
cggggcugcugggggcggga

SEQ ID NO: 2627 - RNA, 20 nt, Artificial Sequence
  synthesized
cucagguacaagucccgccc

SEQ ID NO: 2628 - RNA, 20 nt, Artificial Sequence
  synthesized
cucagguacaaguccugccc

SEQ ID NO: 2629 - RNA, 20 nt, Artificial Sequence
  synthesized
cugcccccagcagccccguc

SEQ ID NO: 2630 - RNA, 20 nt, Artificial Sequence
  synthesized
cugcugggggcaggacuugu

SEQ ID NO: 2631 - RNA, 20 nt, Artificial Sequence
  synthesized
gacggggcugcugggggcag

SEQ ID NO: 2632 - RNA, 20 nt, Artificial Sequence
  synthesized
gacggggcugcugggggcgg

SEQ ID NO: 2633 - RNA, 20 nt, Artificial Sequence
  synthesized
gcagcucagguacaaguccc

SEQ ID NO: 2634 - RNA, 20 nt, Artificial Sequence
  synthesized
gcagcucagguacaaguccu

SEQ ID NO: 2635 - RNA, 20 nt, Artificial Sequence
  synthesized
gcaggacuuguaccugagcu

SEQ ID NO: 2636 - RNA, 20 nt, Artificial Sequence
  synthesized
gcgggacuuguaccugagcu

SEQ ID NO: 2637 - RNA, 20 nt, Artificial Sequence
  synthesized
gcugggggcaggacuuguac

SEQ ID NO: 2638 - RNA, 20 nt, Artificial Sequence
  synthesized
gcugggggcgggacuuguac

SEQ ID NO: 2639 - RNA, 20 nt, Artificial Sequence
  synthesized
ggcagcucagguacaagucc

SEQ ID NO: 2640 - RNA, 20 nt, Artificial Sequence
  synthesized
ggcgggacuuguaccugagc

SEQ ID NO: 2641 - RNA, 20 nt, Artificial Sequence
  synthesized
ggcugcugggggcaggacuu

SEQ ID NO: 2642 - RNA, 20 nt, Artificial Sequence
  synthesized
gggacuuguaccugagcugc

SEQ ID NO: 2643 - RNA, 20 nt, Artificial Sequence
  synthesized
gggcaggacuuguaccugag

SEQ ID NO: 2644 - RNA, 20 nt, Artificial Sequence
  synthesized
gggcgggacuuguaccugag

SEQ ID NO: 2645 - RNA, 20 nt, Artificial Sequence
  synthesized
gggcugcugggggcaggacu

SEQ ID NO: 2646 - RNA, 20 nt, Artificial Sequence
  synthesized
gggcugcugggggcgggacu

SEQ ID NO: 2647 - RNA, 20 nt, Artificial Sequence
  synthesized
ggggcaggacuuguaccuga

SEQ ID NO: 2648 - RNA, 20 nt, Artificial Sequence
  synthesized
ggggcgggacuuguaccuga

SEQ ID NO: 2649 - RNA, 20 nt, Artificial Sequence
  synthesized
ggggcugcugggggcaggac

SEQ ID NO: 2650 - RNA, 20 nt, Artificial Sequence
  synthesized
gggggcaggacuuguaccug

SEQ ID NO: 2651 - RNA, 20 nt, Artificial Sequence
  synthesized
gggggcgggacuuguaccug

SEQ ID NO: 2652 - RNA, 20 nt, Artificial Sequence
  synthesized
guacaaguccugcccccagc

SEQ ID NO: 2653 - RNA, 20 nt, Artificial Sequence
  synthesized
gucccgcccccagcagcccc

SEQ ID NO: 2654 - RNA, 20 nt, Artificial Sequence
  synthesized
uacaagucccgcccccagca

SEQ ID NO: 2655 - RNA, 20 nt, Artificial Sequence
  synthesized
uacaaguccugcccccagca

SEQ ID NO: 2656 - RNA, 20 nt, Artificial Sequence
  synthesized
ucagguacaagucccgcccc

SEQ ID NO: 2657 - RNA, 20 nt, Artificial Sequence
  synthesized
ucagguacaaguccugcccc

SEQ ID NO: 2658 - RNA, 20 nt, Artificial Sequence
  synthesized
ucccgcccccagcagccccg

SEQ ID NO: 2659 - RNA, 20 nt, Artificial Sequence
  synthesized
uccugcccccagcagccccg

SEQ ID NO: 2660 - RNA, 20 nt, Artificial Sequence
  synthesized
ugcccccagcagccccgucu

SEQ ID NO: 2661 - RNA, 20 nt, Artificial Sequence
  synthesized
ugcugggggcaggacuugua

SEQ ID NO: 2662 - RNA, 20 nt, Artificial Sequence
  synthesized
ugggggcaggacuuguaccu

SEQ ID NO: 2663 - RNA, 20 nt, Artificial Sequence
  synthesized
ugggggcgggacuuguaccu

SEQ ID NO: 2664 - RNA, 20 nt, Artificial Sequence
  synthesized
agaugucaacacugaggcuu

SEQ ID NO: 2665 - RNA, 20 nt, Artificial Sequence
  synthesized
aguguugacaucuguaaaac

SEQ ID NO: 2666 - RNA, 20 nt, Artificial Sequence
  synthesized
augucaacacugaggcuuag

SEQ ID NO: 2667 - RNA, 20 nt, Artificial Sequence
  synthesized
caguguugacaucuguaaaa

SEQ ID NO: 2668 - RNA, 20 nt, Artificial Sequence
  synthesized
ccucaguguuaacaucugua

SEQ ID NO: 2669 - RNA, 20 nt, Artificial Sequence
  synthesized
cucaguguuaacaucuguaa

SEQ ID NO: 2670 - RNA, 20 nt, Artificial Sequence
  synthesized
cucaguguugacaucuguaa

SEQ ID NO: 2671 - RNA, 20 nt, Artificial Sequence
  synthesized
cuuucuaagccucaguguug

SEQ ID NO: 2672 - RNA, 20 nt, Artificial Sequence
  synthesized
guguugacaucuguaaaaca

SEQ ID NO: 2673 - RNA, 20 nt, Artificial Sequence
  synthesized
uaagccucaguguugacauc

SEQ ID NO: 2674 - RNA, 20 nt, Artificial Sequence
  synthesized
uacagaugucaacacugagg

SEQ ID NO: 2675 - RNA, 20 nt, Artificial Sequence
  synthesized
uguugacaucuguaaaacag

SEQ ID NO: 2676 - RNA, 20 nt, Artificial Sequence
  synthesized
uucuaagccucaguguugac

SEQ ID NO: 2677 - RNA, 20 nt, Artificial Sequence
  synthesized
aaguccuggaaugugcagcu

SEQ ID NO: 2678 - RNA, 20 nt, Artificial Sequence
  synthesized
aaugugcagcuccccccagg

SEQ ID NO: 2679 - RNA, 20 nt, Artificial Sequence
  synthesized
aaugugcagcuccucccagg

SEQ ID NO: 2680 - RNA, 20 nt, Artificial Sequence
  synthesized
acagcuugggccugggagga

SEQ ID NO: 2681 - RNA, 20 nt, Artificial Sequence
  synthesized
acagcuugggccugggggga

SEQ ID NO: 2682 - RNA, 20 nt, Artificial Sequence
  synthesized
agcuccccccaggcccaagc

SEQ ID NO: 2683 - RNA, 20 nt, Artificial Sequence
  synthesized
agcuugggccugggaggagc

SEQ ID NO: 2684 - RNA, 20 nt, Artificial Sequence
  synthesized
agcuugggccuggggggagc

SEQ ID NO: 2685 - RNA, 20 nt, Artificial Sequence
  synthesized
aggagcugcacauuccagga

SEQ ID NO: 2686 - RNA, 20 nt, Artificial Sequence
  synthesized
augugcagcuccccccaggc

SEQ ID NO: 2687 - RNA, 20 nt, Artificial Sequence
  synthesized
augugcagcuccucccaggc

SEQ ID NO: 2688 - RNA, 20 nt, Artificial Sequence
  synthesized
cagcuccccccaggcccaag

SEQ ID NO: 2689 - RNA, 20 nt, Artificial Sequence
  synthesized
cagcuccucccaggcccaag

SEQ ID NO: 2690 - RNA, 20 nt, Artificial Sequence
  synthesized
cagcuugggccugggaggag

SEQ ID NO: 2691 - RNA, 20 nt, Artificial Sequence
  synthesized
ccccaggcccaagcuguccu

SEQ ID NO: 2692 - RNA, 20 nt, Artificial Sequence
  synthesized
cccccaggcccaagcugucc

SEQ ID NO: 2693 - RNA, 20 nt, Artificial Sequence
  synthesized
ccccccaggcccaagcuguc

SEQ ID NO: 2694 - RNA, 20 nt, Artificial Sequence
  synthesized
ccucccaggcccaagcuguc

SEQ ID NO: 2695 - RNA, 20 nt, Artificial Sequence
  synthesized
ccuggaaugugcagcucccc

SEQ ID NO: 2696 - RNA, 20 nt, Artificial Sequence
  synthesized
ccuggaaugugcagcuccuc

SEQ ID NO: 2697 - RNA, 20 nt, Artificial Sequence
  synthesized
ccuggggggagcugcacauu

SEQ ID NO: 2698 - RNA, 20 nt, Artificial Sequence
  synthesized
cucccaggcccaagcugucc

SEQ ID NO: 2699 - RNA, 20 nt, Artificial Sequence
  synthesized
cuggaaugugcagcuccccc

SEQ ID NO: 2700 - RNA, 20 nt, Artificial Sequence
  synthesized
cugggaggagcugcacauuc

SEQ ID NO: 2701 - RNA, 20 nt, Artificial Sequence
  synthesized
cuggggggagcugcacauuc

SEQ ID NO: 2702 - RNA, 20 nt, Artificial Sequence
  synthesized
cuugggccugggaggagcug

SEQ ID NO: 2703 - RNA, 20 nt, Artificial Sequence
  synthesized
cuugggccuggggggagcug

SEQ ID NO: 2704 - RNA, 20 nt, Artificial Sequence
  synthesized
gaaugugcagcuccccccag

SEQ ID NO: 2705 - RNA, 20 nt, Artificial Sequence
  synthesized
gacagcuugggccugggggg

SEQ ID NO: 2706 - RNA, 20 nt, Artificial Sequence
  synthesized
gcagcuccucccaggcccaa

SEQ ID NO: 2707 - RNA, 20 nt, Artificial Sequence
  synthesized
gccuggggggagcugcacau

SEQ ID NO: 2708 - RNA, 20 nt, Artificial Sequence
  synthesized
gcuugggccugggaggagcu

SEQ ID NO: 2709 - RNA, 20 nt, Artificial Sequence
  synthesized
gcuugggccuggggggagcu

SEQ ID NO: 2710 - RNA, 20 nt, Artificial Sequence
  synthesized
ggaaugugcagcucccccca

SEQ ID NO: 2711 - RNA, 20 nt, Artificial Sequence
  synthesized
ggaaugugcagcuccuccca

SEQ ID NO: 2712 - RNA, 20 nt, Artificial Sequence
  synthesized
ggaggagcugcacauuccag

SEQ ID NO: 2713 - RNA, 20 nt, Artificial Sequence
  synthesized
ggccugggaggagcugcaca

SEQ ID NO: 2714 - RNA, 20 nt, Artificial Sequence
  synthesized
ggccuggggggagcugcaca

SEQ ID NO: 2715 - RNA, 20 nt, Artificial Sequence
  synthesized
gggagcugcacauuccagga

SEQ ID NO: 2716 - RNA, 20 nt, Artificial Sequence
  synthesized
gggaggagcugcacauucca

SEQ ID NO: 2717 - RNA, 20 nt, Artificial Sequence
  synthesized
gggccuggggggagcugcac

SEQ ID NO: 2718 - RNA, 20 nt, Artificial Sequence
  synthesized
ggggagcugcacauuccagg

SEQ ID NO: 2719 - RNA, 20 nt, Artificial Sequence
  synthesized
gggggagcugcacauuccag

SEQ ID NO: 2720 - RNA, 20 nt, Artificial Sequence
  synthesized
ggggggagcugcacauucca

SEQ ID NO: 2721 - RNA, 20 nt, Artificial Sequence
  synthesized
gugcagcuccccccaggccc

SEQ ID NO: 2722 - RNA, 20 nt, Artificial Sequence
  synthesized
gugcagcuccucccaggccc

SEQ ID NO: 2723 - RNA, 20 nt, Artificial Sequence
  synthesized
ucccaggcccaagcuguccu

SEQ ID NO: 2724 - RNA, 20 nt, Artificial Sequence
  synthesized
uccuggaaugugcagcuccc

SEQ ID NO: 2725 - RNA, 20 nt, Artificial Sequence
  synthesized
uccuggaaugugcagcuccu

SEQ ID NO: 2726 - RNA, 20 nt, Artificial Sequence
  synthesized
ugcagcuccccccaggccca

SEQ ID NO: 2727 - RNA, 20 nt, Artificial Sequence
  synthesized
ugcagcuccucccaggccca

SEQ ID NO: 2728 - RNA, 20 nt, Artificial Sequence
  synthesized
uggaaugugcagcucccccc

SEQ ID NO: 2729 - RNA, 20 nt, Artificial Sequence
  synthesized
ugggaggagcugcacauucc

SEQ ID NO: 2730 - RNA, 20 nt, Artificial Sequence
  synthesized
ugggccugggaggagcugca

SEQ ID NO: 2731 - RNA, 20 nt, Artificial Sequence
  synthesized
ugggccuggggggagcugca

SEQ ID NO: 2732 - RNA, 20 nt, Artificial Sequence
  synthesized
uggggggagcugcacauucc

SEQ ID NO: 2733 - RNA, 20 nt, Artificial Sequence
  synthesized
ugugcagcuccccccaggcc

SEQ ID NO: 2734 - RNA, 20 nt, Artificial Sequence
  synthesized
ugugcagcuccucccaggcc

SEQ ID NO: 2735 - RNA, 20 nt, Artificial Sequence
  synthesized
uugggccugggaggagcugc

SEQ ID NO: 2736 - RNA, 20 nt, Artificial Sequence
  synthesized
uugggccuggggggagcugc

SEQ ID NO: 2737 - RNA, 20 nt, Artificial Sequence
  synthesized
aaaaaaucugaggauguagg

SEQ ID NO: 2738 - RNA, 20 nt, Artificial Sequence
  synthesized
aaaaaucugaggauguaggu

SEQ ID NO: 2739 - RNA, 20 nt, Artificial Sequence
  synthesized
aaaauaucugaggauguagg

SEQ ID NO: 2740 - RNA, 20 nt, Artificial Sequence
  synthesized
aaaaucugaggauguagguc

SEQ ID NO: 2741 - RNA, 20 nt, Artificial Sequence
  synthesized
aaauaucugaggauguaggu

SEQ ID NO: 2742 - RNA, 20 nt, Artificial Sequence
  synthesized
aaaucugaggauguaggucc

SEQ ID NO: 2743 - RNA, 20 nt, Artificial Sequence
  synthesized
aauaucugaggauguagguc

SEQ ID NO: 2744 - RNA, 20 nt, Artificial Sequence
  synthesized
aaucugaggauguagguccu

SEQ ID NO: 2745 - RNA, 20 nt, Artificial Sequence
  synthesized
accuacauccucagauauuu

SEQ ID NO: 2746 - RNA, 20 nt, Artificial Sequence
  synthesized
aggaccuacauccucagaua

SEQ ID NO: 2747 - RNA, 20 nt, Artificial Sequence
  synthesized
aggaccuacauccucagauu

SEQ ID NO: 2748 - RNA, 20 nt, Artificial Sequence
  synthesized
auaucugaggauguaggucc

SEQ ID NO: 2749 - RNA, 20 nt, Artificial Sequence
  synthesized
cccccuuaaaaaauaucuga

SEQ ID NO: 2750 - RNA, 20 nt, Artificial Sequence
  synthesized
cccucccccuuaaaaaauau

SEQ ID NO: 2751 - RNA, 20 nt, Artificial Sequence
  synthesized
ccucccccuuaaaaaauauc

SEQ ID NO: 2752 - RNA, 20 nt, Artificial Sequence
  synthesized
cguucccccucccccuuaaa

SEQ ID NO: 2753 - RNA, 20 nt, Artificial Sequence
  synthesized
cucccccuuaaaaaauaucu

SEQ ID NO: 2754 - RNA, 20 nt, Artificial Sequence
  synthesized
gaccuacauccucagauauu

SEQ ID NO: 2755 - RNA, 20 nt, Artificial Sequence
  synthesized
ggaccuacauccucagauau

SEQ ID NO: 2756 - RNA, 20 nt, Artificial Sequence
  synthesized
ggaccuacauccucagauuu

SEQ ID NO: 2757 - RNA, 20 nt, Artificial Sequence
  synthesized
uaucugaggauguagguccu

SEQ ID NO: 2758 - RNA, 20 nt, Artificial Sequence
  synthesized
uucccccucccccuuaaaaa

SEQ ID NO: 2759 - RNA, 20 nt, Artificial Sequence
  synthesized
acccuaaggaaaagcacaaa

SEQ ID NO: 2760 - RNA, 20 nt, Artificial Sequence
  synthesized
agacccuaaggaaaagcaca

SEQ ID NO: 2761 - RNA, 20 nt, Artificial Sequence
  synthesized
cagacccuaaggaaaagcac

SEQ ID NO: 2762 - RNA, 20 nt, Artificial Sequence
  synthesized
ccagacccuaaggaaaagca

SEQ ID NO: 2763 - RNA, 20 nt, Artificial Sequence
  synthesized
cccagacccuaaggaaaagc

SEQ ID NO: 2764 - RNA, 20 nt, Artificial Sequence
  synthesized
cccuaaggaaaagcacaaaa

SEQ ID NO: 2765 - RNA, 20 nt, Artificial Sequence
  synthesized
ccuaaggaaaagcacaaaaa

SEQ ID NO: 2766 - RNA, 20 nt, Artificial Sequence
  synthesized
cuccuuagggucugggcccu

SEQ ID NO: 2767 - RNA, 20 nt, Artificial Sequence
  synthesized
gacccuaaggaaaagcacaa

SEQ ID NO: 2768 - RNA, 20 nt, Artificial Sequence
  synthesized
gcccagacccuaaggaaaag

SEQ ID NO: 2769 - RNA, 20 nt, Artificial Sequence
  synthesized
ggcccagacccuaaggaaaa

SEQ ID NO: 2770 - RNA, 20 nt, Artificial Sequence
  synthesized
gggcccagacccuaaggaaa

SEQ ID NO: 2771 - RNA, 20 nt, Artificial Sequence
  synthesized
ucuccuuagggucugggccc

SEQ ID NO: 2772 - RNA, 20 nt, Artificial Sequence
  synthesized
uuccuuagggucugggcccu

SEQ ID NO: 2773 - RNA, 20 nt, Artificial Sequence
  synthesized
uucuccuuagggucugggcc

SEQ ID NO: 2774 - RNA, 20 nt, Artificial Sequence
  synthesized
uuuccuuagggucugggccc

SEQ ID NO: 2775 - RNA, 20 nt, Artificial Sequence
  synthesized
aaguaggaagugagcuugua

SEQ ID NO: 2776 - RNA, 20 nt, Artificial Sequence
  synthesized
aaguaggaagugagcuugug

SEQ ID NO: 2777 - RNA, 20 nt, Artificial Sequence
  synthesized
acuuccauuucuggcacaag

SEQ ID NO: 2778 - RNA, 20 nt, Artificial Sequence
  synthesized
acuuccauuucugguacaag

SEQ ID NO: 2779 - RNA, 20 nt, Artificial Sequence
  synthesized
agacuuccauuucuggcaca

SEQ ID NO: 2780 - RNA, 20 nt, Artificial Sequence
  synthesized
agacuuccauuucugguaca

SEQ ID NO: 2781 - RNA, 20 nt, Artificial Sequence
  synthesized
agcuuguaccagaaauggaa

SEQ ID NO: 2782 - RNA, 20 nt, Artificial Sequence
  synthesized
agcuugugccagaaauggaa

SEQ ID NO: 2783 - RNA, 20 nt, Artificial Sequence
  synthesized
aggaagugagcuugugccag

SEQ ID NO: 2784 - RNA, 20 nt, Artificial Sequence
  synthesized
aguaggaagugagcuuguac

SEQ ID NO: 2785 - RNA, 20 nt, Artificial Sequence
  synthesized
aguaggaagugagcuugugc

SEQ ID NO: 2786 - RNA, 20 nt, Artificial Sequence
  synthesized
auuucuggcacaagcucacu

SEQ ID NO: 2787 - RNA, 20 nt, Artificial Sequence
  synthesized
cacaagcucacuuccuacuu

SEQ ID NO: 2788 - RNA, 20 nt, Artificial Sequence
  synthesized
cagacuuccauuucuggcac

SEQ ID NO: 2789 - RNA, 20 nt, Artificial Sequence
  synthesized
cagacuuccauuucugguac

SEQ ID NO: 2790 - RNA, 20 nt, Artificial Sequence
  synthesized
cauuucuggcacaagcucac

SEQ ID NO: 2791 - RNA, 20 nt, Artificial Sequence
  synthesized
cauuucugguacaagcucac

SEQ ID NO: 2792 - RNA, 20 nt, Artificial Sequence
  synthesized
ccauuucuggcacaagcuca

SEQ ID NO: 2793 - RNA, 20 nt, Artificial Sequence
  synthesized
ccauuucugguacaagcuca

SEQ ID NO: 2794 - RNA, 20 nt, Artificial Sequence
  synthesized
cuggcacaagcucacuuccu

SEQ ID NO: 2795 - RNA, 20 nt, Artificial Sequence
  synthesized
cugguacaagcucacuuccu

SEQ ID NO: 2796 - RNA, 20 nt, Artificial Sequence
  synthesized
cuuccauuucuggcacaagc

SEQ ID NO: 2797 - RNA, 20 nt, Artificial Sequence
  synthesized
cuuccauuucugguacaagc

SEQ ID NO: 2798 - RNA, 20 nt, Artificial Sequence
  synthesized
cuuguaccagaaauggaagu

SEQ ID NO: 2799 - RNA, 20 nt, Artificial Sequence
  synthesized
cuugugccagaaauggaagu

SEQ ID NO: 2800 - RNA, 20 nt, Artificial Sequence
  synthesized
gaagugagcuuguaccagaa

SEQ ID NO: 2801 - RNA, 20 nt, Artificial Sequence
  synthesized
gaagugagcuugugccagaa

SEQ ID NO: 2802 - RNA, 20 nt, Artificial Sequence
  synthesized
gacuuccauuucuggcacaa

SEQ ID NO: 2803 - RNA, 20 nt, Artificial Sequence
  synthesized
gacuuccauuucugguacaa

SEQ ID NO: 2804 - RNA, 20 nt, Artificial Sequence
  synthesized
gagcuuguaccagaaaugga

SEQ ID NO: 2805 - RNA, 20 nt, Artificial Sequence
  synthesized
gagcuugugccagaaaugga

SEQ ID NO: 2806 - RNA, 20 nt, Artificial Sequence
  synthesized
gcacaagcucacuuccuacu

SEQ ID NO: 2807 - RNA, 20 nt, Artificial Sequence
  synthesized
gcagacuuccauuucuggca

SEQ ID NO: 2808 - RNA, 20 nt, Artificial Sequence
  synthesized
gcagacuuccauuucuggua

SEQ ID NO: 2809 - RNA, 20 nt, Artificial Sequence
  synthesized
gccagaaauggaagucugca

SEQ ID NO: 2810 - RNA, 20 nt, Artificial Sequence
  synthesized
gcuuguaccagaaauggaag

SEQ ID NO: 2811 - RNA, 20 nt, Artificial Sequence
  synthesized
gcuugugccagaaauggaag

SEQ ID NO: 2812 - RNA, 20 nt, Artificial Sequence
  synthesized
ggaagugagcuuguaccaga

SEQ ID NO: 2813 - RNA, 20 nt, Artificial Sequence
  synthesized
ggaagugagcuugugccaga

SEQ ID NO: 2814 - RNA, 20 nt, Artificial Sequence
  synthesized
ggcacaagcucacuuccuac

SEQ ID NO: 2815 - RNA, 20 nt, Artificial Sequence
  synthesized
gguacaagcucacuuccuac

SEQ ID NO: 2816 - RNA, 20 nt, Artificial Sequence
  synthesized
guacaagcucacuuccuacu

SEQ ID NO: 2817 - RNA, 20 nt, Artificial Sequence
  synthesized
guaccagaaauggaagucug

SEQ ID NO: 2818 - RNA, 20 nt, Artificial Sequence
  synthesized
gugagcuuguaccagaaaug

SEQ ID NO: 2819 - RNA, 20 nt, Artificial Sequence
  synthesized
gugagcuugugccagaaaug

SEQ ID NO: 2820 - RNA, 20 nt, Artificial Sequence
  synthesized
gugccagaaauggaagucug

SEQ ID NO: 2821 - RNA, 20 nt, Artificial Sequence
  synthesized
uacaagcucacuuccuacuu

SEQ ID NO: 2822 - RNA, 20 nt, Artificial Sequence
  synthesized
uaccagaaauggaagucugc

SEQ ID NO: 2823 - RNA, 20 nt, Artificial Sequence
  synthesized
uaggaagugagcuuguacca

SEQ ID NO: 2824 - RNA, 20 nt, Artificial Sequence
  synthesized
uaggaagugagcuugugcca

SEQ ID NO: 2825 - RNA, 20 nt, Artificial Sequence
  synthesized
uccauuucuggcacaagcuc

SEQ ID NO: 2826 - RNA, 20 nt, Artificial Sequence
  synthesized
uccauuucugguacaagcuc

SEQ ID NO: 2827 - RNA, 20 nt, Artificial Sequence
  synthesized
ucuggcacaagcucacuucc

SEQ ID NO: 2828 - RNA, 20 nt, Artificial Sequence
  synthesized
ucugguacaagcucacuucc

SEQ ID NO: 2829 - RNA, 20 nt, Artificial Sequence
  synthesized
ugagcuuguaccagaaaugg

SEQ ID NO: 2830 - RNA, 20 nt, Artificial Sequence
  synthesized
ugagcuugugccagaaaugg

SEQ ID NO: 2831 - RNA, 20 nt, Artificial Sequence
  synthesized
ugcagacuuccauuucuggc

SEQ ID NO: 2832 - RNA, 20 nt, Artificial Sequence
  synthesized
ugcagacuuccauuucuggu

SEQ ID NO: 2833 - RNA, 20 nt, Artificial Sequence
  synthesized
ugccagaaauggaagucugc

SEQ ID NO: 2834 - RNA, 20 nt, Artificial Sequence
  synthesized
uggcacaagcucacuuccua

SEQ ID NO: 2835 - RNA, 20 nt, Artificial Sequence
  synthesized
ugguacaagcucacuuccua

SEQ ID NO: 2836 - RNA, 20 nt, Artificial Sequence
  synthesized
uguaccagaaauggaagucu

SEQ ID NO: 2837 - RNA, 20 nt, Artificial Sequence
  synthesized
ugugccagaaauggaagucu

SEQ ID NO: 2838 - RNA, 20 nt, Artificial Sequence
  synthesized
uuccauuucuggcacaagcu

SEQ ID NO: 2839 - RNA, 20 nt, Artificial Sequence
  synthesized
uuccauuucugguacaagcu

SEQ ID NO: 2840 - RNA, 20 nt, Artificial Sequence
  synthesized
uucuggcacaagcucacuuc

SEQ ID NO: 2841 - RNA, 20 nt, Artificial Sequence
  synthesized
uucugguacaagcucacuuc

SEQ ID NO: 2842 - RNA, 20 nt, Artificial Sequence
  synthesized
uuucuggcacaagcucacuu

SEQ ID NO: 2843 - RNA, 20 nt, Artificial Sequence
  synthesized
uuucugguacaagcucacuu

SEQ ID NO: 2844 - RNA, 20 nt, Artificial Sequence
  synthesized
aagcuccgccucccggguuc

SEQ ID NO: 2845 - RNA, 20 nt, Artificial Sequence
  synthesized
augccauucuucugccucag

SEQ ID NO: 2846 - RNA, 20 nt, Artificial Sequence
  synthesized
ccgccucccggguucaugcc

SEQ ID NO: 2847 - RNA, 20 nt, Artificial Sequence
  synthesized
gaauggcaugaacccgggag

SEQ ID NO: 2848 - RNA, 20 nt, Artificial Sequence
  synthesized
gaggcugaggcagaagaaug

SEQ ID NO: 2849 - RNA, 20 nt, Artificial Sequence
  synthesized
gcaugaacccgggaggcgga

SEQ ID NO: 2850 - RNA, 20 nt, Artificial Sequence
  synthesized
ucccggguucaugccauucu

SEQ ID NO: 2851 - RNA, 20 nt, Artificial Sequence
  synthesized
ugaggcagaagaauggcaug

SEQ ID NO: 2852 - RNA, 20 nt, Artificial Sequence
  synthesized
aaccaagcuugggcccuuca

SEQ ID NO: 2853 - RNA, 20 nt, Artificial Sequence
  synthesized
aaccaagcuugggcccuucg

SEQ ID NO: 2854 - RNA, 20 nt, Artificial Sequence
  synthesized
aagcuugggcccuucagagc

SEQ ID NO: 2855 - RNA, 20 nt, Artificial Sequence
  synthesized
aagcuugggcccuucggagc

SEQ ID NO: 2856 - RNA, 20 nt, Artificial Sequence
  synthesized
accaagcuugggcccuucag

SEQ ID NO: 2857 - RNA, 20 nt, Artificial Sequence
  synthesized
accaagcuugggcccuucgg

SEQ ID NO: 2858 - RNA, 20 nt, Artificial Sequence
  synthesized
agagcacgaggcccugugug

SEQ ID NO: 2859 - RNA, 20 nt, Artificial Sequence
  synthesized
agggccucgugcuccgaagg

SEQ ID NO: 2860 - RNA, 20 nt, Artificial Sequence
  synthesized
agggccucgugcucugaagg

SEQ ID NO: 2861 - RNA, 20 nt, Artificial Sequence
  synthesized
caagcuugggcccuucagag

SEQ ID NO: 2862 - RNA, 20 nt, Artificial Sequence
  synthesized
caagcuugggcccuucggag

SEQ ID NO: 2863 - RNA, 20 nt, Artificial Sequence
  synthesized
cagagcacgaggcccugugu

SEQ ID NO: 2864 - RNA, 20 nt, Artificial Sequence
  synthesized
cagggccucgugcuccgaag

SEQ ID NO: 2865 - RNA, 20 nt, Artificial Sequence
  synthesized
cagggccucgugcucugaag

SEQ ID NO: 2866 - RNA, 20 nt, Artificial Sequence
  synthesized
ccaagcuugggcccuucaga

SEQ ID NO: 2867 - RNA, 20 nt, Artificial Sequence
  synthesized
ccaagcuugggcccuucgga

SEQ ID NO: 2868 - RNA, 20 nt, Artificial Sequence
  synthesized
ccgaagggcccaagcuuggu

SEQ ID NO: 2869 - RNA, 20 nt, Artificial Sequence
  synthesized
ccucgugcuccgaagggccc

SEQ ID NO: 2870 - RNA, 20 nt, Artificial Sequence
  synthesized
cgaagggcccaagcuugguu

SEQ ID NO: 2871 - RNA, 20 nt, Artificial Sequence
  synthesized
cggagcacgaggcccugugu

SEQ ID NO: 2872 - RNA, 20 nt, Artificial Sequence
  synthesized
cgugcuccgaagggcccaag

SEQ ID NO: 2873 - RNA, 20 nt, Artificial Sequence
  synthesized
cgugcucugaagggcccaag

SEQ ID NO: 2874 - RNA, 20 nt, Artificial Sequence
  synthesized
cuccgaagggcccaagcuug

SEQ ID NO: 2875 - RNA, 20 nt, Artificial Sequence
  synthesized
cucgugcuccgaagggccca

SEQ ID NO: 2876 - RNA, 20 nt, Artificial Sequence
  synthesized
cucugaagggcccaagcuug

SEQ ID NO: 2877 - RNA, 20 nt, Artificial Sequence
  synthesized
cugaagggcccaagcuuggu

SEQ ID NO: 2878 - RNA, 20 nt, Artificial Sequence
  synthesized
gcccuucagagcacgaggcc

SEQ ID NO: 2879 - RNA, 20 nt, Artificial Sequence
  synthesized
gcccuucggagcacgaggcc

SEQ ID NO: 2880 - RNA, 20 nt, Artificial Sequence
  synthesized
gccucgugcuccgaagggcc

SEQ ID NO: 2881 - RNA, 20 nt, Artificial Sequence
  synthesized
gccucgugcucugaagggcc

SEQ ID NO: 2882 - RNA, 20 nt, Artificial Sequence
  synthesized
gcuccgaagggcccaagcuu

SEQ ID NO: 2883 - RNA, 20 nt, Artificial Sequence
  synthesized
gcucugaagggcccaagcuu

SEQ ID NO: 2884 - RNA, 20 nt, Artificial Sequence
  synthesized
gcuugggcccuucggagcac

SEQ ID NO: 2885 - RNA, 20 nt, Artificial Sequence
  synthesized
ggagcacgaggcccugugug

SEQ ID NO: 2886 - RNA, 20 nt, Artificial Sequence
  synthesized
ggcccuucagagcacgaggc

SEQ ID NO: 2887 - RNA, 20 nt, Artificial Sequence
  synthesized
ggcccuucggagcacgaggc

SEQ ID NO: 2888 - RNA, 20 nt, Artificial Sequence
  synthesized
ggccucgugcuccgaagggc

SEQ ID NO: 2889 - RNA, 20 nt, Artificial Sequence
  synthesized
ggccucgugcucugaagggc

SEQ ID NO: 2890 - RNA, 20 nt, Artificial Sequence
  synthesized
gggcccuucagagcacgagg

SEQ ID NO: 2891 - RNA, 20 nt, Artificial Sequence
  synthesized
gggcccuucggagcacgagg

SEQ ID NO: 2892 - RNA, 20 nt, Artificial Sequence
  synthesized
gggccucgugcuccgaaggg

SEQ ID NO: 2893 - RNA, 20 nt, Artificial Sequence
  synthesized
gggccucgugcucugaaggg

SEQ ID NO: 2894 - RNA, 20 nt, Artificial Sequence
  synthesized
gugcuccgaagggcccaagc

SEQ ID NO: 2895 - RNA, 20 nt, Artificial Sequence
  synthesized
gugcucugaagggcccaagc

SEQ ID NO: 2896 - RNA, 20 nt, Artificial Sequence
  synthesized
uccgaagggcccaagcuugg

SEQ ID NO: 2897 - RNA, 20 nt, Artificial Sequence
  synthesized
ucgugcuccgaagggcccaa

SEQ ID NO: 2898 - RNA, 20 nt, Artificial Sequence
  synthesized
ucgugcucugaagggcccaa

SEQ ID NO: 2899 - RNA, 20 nt, Artificial Sequence
  synthesized
ucugaagggcccaagcuugg

SEQ ID NO: 2900 - RNA, 20 nt, Artificial Sequence
  synthesized
ugaagggcccaagcuugguu

SEQ ID NO: 2901 - RNA, 20 nt, Artificial Sequence
  synthesized
ugggcccuucagagcacgag

SEQ ID NO: 2902 - RNA, 20 nt, Artificial Sequence
  synthesized
ugggcccuucggagcacgag

SEQ ID NO: 2903 - RNA, 20 nt, Artificial Sequence
  synthesized
uucagagcacgaggcccugu

SEQ ID NO: 2904 - RNA, 20 nt, Artificial Sequence
  synthesized
uucggagcacgaggcccugu

SEQ ID NO: 2905 - RNA, 20 nt, Artificial Sequence
  synthesized
uugggcccuucagagcacga

SEQ ID NO: 2906 - RNA, 20 nt, Artificial Sequence
  synthesized
uugggcccuucggagcacga

SEQ ID NO: 2907 - RNA, 20 nt, Artificial Sequence
  synthesized
aacuggcccggccgcgccuu

SEQ ID NO: 2908 - RNA, 20 nt, Artificial Sequence
  synthesized
aacuggccuggccgcgccuu

SEQ ID NO: 2909 - RNA, 20 nt, Artificial Sequence
  synthesized
aagagaacuggcccggccgc

SEQ ID NO: 2910 - RNA, 20 nt, Artificial Sequence
  synthesized
aagagaacuggccuggccgc

SEQ ID NO: 2911 - RNA, 20 nt, Artificial Sequence
  synthesized
aaggcgcggccaggccaguu

SEQ ID NO: 2912 - RNA, 20 nt, Artificial Sequence
  synthesized
aaggcgcggccgggccaguu

SEQ ID NO: 2913 - RNA, 20 nt, Artificial Sequence
  synthesized
acuggcccggccgcgccuuc

SEQ ID NO: 2914 - RNA, 20 nt, Artificial Sequence
  synthesized
acuggccuggccgcgccuuc

SEQ ID NO: 2915 - RNA, 20 nt, Artificial Sequence
  synthesized
agaacuggccuggccgcgcc

SEQ ID NO: 2916 - RNA, 20 nt, Artificial Sequence
  synthesized
agaaggcgcggccaggccag

SEQ ID NO: 2917 - RNA, 20 nt, Artificial Sequence
  synthesized
agagaacuggcccggccgcg

SEQ ID NO: 2918 - RNA, 20 nt, Artificial Sequence
  synthesized
agagaacuggccuggccgcg

SEQ ID NO: 2919 - RNA, 20 nt, Artificial Sequence
  synthesized
agcuggagaaggcgcggcca

SEQ ID NO: 2920 - RNA, 20 nt, Artificial Sequence
  synthesized
agcuggagaaggcgcggccg

SEQ ID NO: 2921 - RNA, 20 nt, Artificial Sequence
  synthesized
aggcgcggccaggccaguuc

SEQ ID NO: 2922 - RNA, 20 nt, Artificial Sequence
  synthesized
aggcgcggccgggccaguuc

SEQ ID NO: 2923 - RNA, 20 nt, Artificial Sequence
  synthesized
caagagaacuggcccggccg

SEQ ID NO: 2924 - RNA, 20 nt, Artificial Sequence
  synthesized
caagagaacuggccuggccg

SEQ ID NO: 2925 - RNA, 20 nt, Artificial Sequence
  synthesized
caggccaguucucuugagaa

SEQ ID NO: 2926 - RNA, 20 nt, Artificial Sequence
  synthesized
cccggccgcgccuucuccag

SEQ ID NO: 2927 - RNA, 20 nt, Artificial Sequence
  synthesized
ccuggccgcgccuucuccag

SEQ ID NO: 2928 - RNA, 20 nt, Artificial Sequence
  synthesized
cggccgcgccuucuccagcu

SEQ ID NO: 2929 - RNA, 20 nt, Artificial Sequence
  synthesized
cgggccaguucucuugagaa

SEQ ID NO: 2930 - RNA, 20 nt, Artificial Sequence
  synthesized
cuucucaagagaacuggccu

SEQ ID NO: 2931 - RNA, 20 nt, Artificial Sequence
  synthesized
gaacuggcccggccgcgccu

SEQ ID NO: 2932 - RNA, 20 nt, Artificial Sequence
  synthesized
gaacuggccuggccgcgccu

SEQ ID NO: 2933 - RNA, 20 nt, Artificial Sequence
  synthesized
gaaggcgcggccaggccagu

SEQ ID NO: 2934 - RNA, 20 nt, Artificial Sequence
  synthesized
gaaggcgcggccgggccagu

SEQ ID NO: 2935 - RNA, 20 nt, Artificial Sequence
  synthesized
gagaacuggcccggccgcgc

SEQ ID NO: 2936 - RNA, 20 nt, Artificial Sequence
  synthesized
gagaacuggccuggccgcgc

SEQ ID NO: 2937 - RNA, 20 nt, Artificial Sequence
  synthesized
gagaaggcgcggccaggcca

SEQ ID NO: 2938 - RNA, 20 nt, Artificial Sequence
  synthesized
gagaaggcgcggccgggcca

SEQ ID NO: 2939 - RNA, 20 nt, Artificial Sequence
  synthesized
gccaggccaguucucuugag

SEQ ID NO: 2940 - RNA, 20 nt, Artificial Sequence
  synthesized
gcccggccgcgccuucucca

SEQ ID NO: 2941 - RNA, 20 nt, Artificial Sequence
  synthesized
gccgggccaguucucuugag

SEQ ID NO: 2942 - RNA, 20 nt, Artificial Sequence
  synthesized
gccuggccgcgccuucucca

SEQ ID NO: 2943 - RNA, 20 nt, Artificial Sequence
  synthesized
gcgcggccaggccaguucuc

SEQ ID NO: 2944 - RNA, 20 nt, Artificial Sequence
  synthesized
gcgcggccgggccaguucuc

SEQ ID NO: 2945 - RNA, 20 nt, Artificial Sequence
  synthesized
gcggccaggccaguucucuu

SEQ ID NO: 2946 - RNA, 20 nt, Artificial Sequence
  synthesized
gcggccgggccaguucucuu

SEQ ID NO: 2947 - RNA, 20 nt, Artificial Sequence
  synthesized
gcuggagaaggcgcggccag

SEQ ID NO: 2948 - RNA, 20 nt, Artificial Sequence
  synthesized
gcuggagaaggcgcggccgg

SEQ ID NO: 2949 - RNA, 20 nt, Artificial Sequence
  synthesized
ggagaaggcgcggccaggcc

SEQ ID NO: 2950 - RNA, 20 nt, Artificial Sequence
  synthesized
ggagaaggcgcggccgggcc

SEQ ID NO: 2951 - RNA, 20 nt, Artificial Sequence
  synthesized
ggccaggccaguucucuuga

SEQ ID NO: 2952 - RNA, 20 nt, Artificial Sequence
  synthesized
ggcccggccgcgccuucucc

SEQ ID NO: 2953 - RNA, 20 nt, Artificial Sequence
  synthesized
ggccuggccgcgccuucucc

SEQ ID NO: 2954 - RNA, 20 nt, Artificial Sequence
  synthesized
ggcgcggccaggccaguucu

SEQ ID NO: 2955 - RNA, 20 nt, Artificial Sequence
  synthesized
ggcgcggccgggccaguucu

SEQ ID NO: 2956 - RNA, 20 nt, Artificial Sequence
  synthesized
ucaagagaacuggcccggcc

SEQ ID NO: 2957 - RNA, 20 nt, Artificial Sequence
  synthesized
ucaagagaacuggccuggcc

SEQ ID NO: 2958 - RNA, 20 nt, Artificial Sequence
  synthesized
uggagaaggcgcggccaggc

SEQ ID NO: 2959 - RNA, 20 nt, Artificial Sequence
  synthesized
uggagaaggcgcggccgggc

SEQ ID NO: 2960 - RNA, 20 nt, Artificial Sequence
  synthesized
uggcccggccgcgccuucuc

SEQ ID NO: 2961 - RNA, 20 nt, Artificial Sequence
  synthesized
uggccgcgccuucuccagcu

SEQ ID NO: 2962 - RNA, 20 nt, Artificial Sequence
  synthesized
uggccuggccgcgccuucuc

SEQ ID NO: 2963 - RNA, 20 nt, Artificial Sequence
  synthesized
uucucaagagaacuggcccg

SEQ ID NO: 2964 - RNA, 20 nt, Artificial Sequence
  synthesized
uucucaagagaacuggccug

SEQ ID NO: 2965 - RNA, 20 nt, Artificial Sequence
  synthesized
accuccccgucuugucccca

SEQ ID NO: 2966 - RNA, 20 nt, Artificial Sequence
  synthesized
ccaccgggcugcgugagugu

SEQ ID NO: 2967 - RNA, 20 nt, Artificial Sequence
  synthesized
ccccaucacacucacgcagc

SEQ ID NO: 2968 - RNA, 20 nt, Artificial Sequence
  synthesized
ccccgucacacucacgcagc

SEQ ID NO: 2969 - RNA, 20 nt, Artificial Sequence
  synthesized
ccccgucuuguccccaucac

SEQ ID NO: 2970 - RNA, 20 nt, Artificial Sequence
  synthesized
cccgucuuguccccaucaca

SEQ ID NO: 2971 - RNA, 20 nt, Artificial Sequence
  synthesized
ccuccccgucuuguccccau

SEQ ID NO: 2972 - RNA, 20 nt, Artificial Sequence
  synthesized
cgucacacucacgcagcccg

SEQ ID NO: 2973 - RNA, 20 nt, Artificial Sequence
  synthesized
cgucuuguccccaucacacu

SEQ ID NO: 2974 - RNA, 20 nt, Artificial Sequence
  synthesized
cgugagugugauggggacaa

SEQ ID NO: 2975 - RNA, 20 nt, Artificial Sequence
  synthesized
cugcgugagugugaugggga

SEQ ID NO: 2976 - RNA, 20 nt, Artificial Sequence
  synthesized
cuuguccccaucacacucac

SEQ ID NO: 2977 - RNA, 20 nt, Artificial Sequence
  synthesized
gauggggacaagacggggag

SEQ ID NO: 2978 - RNA, 20 nt, Artificial Sequence
  synthesized
gcugcgugagugugacgggg

SEQ ID NO: 2979 - RNA, 20 nt, Artificial Sequence
  synthesized
gcugcgugagugugaugggg

SEQ ID NO: 2980 - RNA, 20 nt, Artificial Sequence
  synthesized
ggcugcgugagugugauggg

SEQ ID NO: 2981 - RNA, 20 nt, Artificial Sequence
  synthesized
guccccgucacacucacgca

SEQ ID NO: 2982 - RNA, 20 nt, Artificial Sequence
  synthesized
gucuuguccccaucacacuc

SEQ ID NO: 2983 - RNA, 20 nt, Artificial Sequence
  synthesized
gugagugugauggggacaag

SEQ ID NO: 2984 - RNA, 20 nt, Artificial Sequence
  synthesized
uccccgucacacucacgcag

SEQ ID NO: 2985 - RNA, 20 nt, Artificial Sequence
  synthesized
uccccgucuuguccccauca

SEQ ID NO: 2986 - RNA, 20 nt, Artificial Sequence
  synthesized
ugcgugagugugauggggac

SEQ ID NO: 2987 - RNA, 20 nt, Artificial Sequence
  synthesized
uguccccaucacacucacgc

SEQ ID NO: 2988 - RNA, 20 nt, Artificial Sequence
  synthesized
uguccccgucacacucacgc

SEQ ID NO: 2989 - RNA, 20 nt, Artificial Sequence
  synthesized
ugugauggggacaagacggg

SEQ ID NO: 2990 - RNA, 20 nt, Artificial Sequence
  synthesized
uuguccccaucacacucacg

SEQ ID NO: 2991 - RNA, 20 nt, Artificial Sequence
  synthesized
uuguccccgucacacucacg

SEQ ID NO: 2992 - RNA, 20 nt, Artificial Sequence
  synthesized
aauaccacggcacauggccu

SEQ ID NO: 2993 - RNA, 20 nt, Artificial Sequence
  synthesized
aauaccauggcacauggccu

SEQ ID NO: 2994 - RNA, 20 nt, Artificial Sequence
  synthesized
accacggcacauggccuggu

SEQ ID NO: 2995 - RNA, 20 nt, Artificial Sequence
  synthesized
accaggccaugugccauggu

SEQ ID NO: 2996 - RNA, 20 nt, Artificial Sequence
  synthesized
accaggccaugugccguggu

SEQ ID NO: 2997 - RNA, 20 nt, Artificial Sequence
  synthesized
accauggcacauggccuggu

SEQ ID NO: 2998 - RNA, 20 nt, Artificial Sequence
  synthesized
acccaaauaccacggcacau

SEQ ID NO: 2999 - RNA, 20 nt, Artificial Sequence
  synthesized
acccaaauaccauggcacau

SEQ ID NO: 3000 - RNA, 20 nt, Artificial Sequence
  synthesized
acccucccaggacccaaaua

SEQ ID NO: 3001 - RNA, 20 nt, Artificial Sequence
  synthesized
acggcacauggccugguauc

SEQ ID NO: 3002 - RNA, 20 nt, Artificial Sequence
  synthesized
auggcacauggccugguauc

SEQ ID NO: 3003 - RNA, 20 nt, Artificial Sequence
  synthesized
augugccaugguauuugggu

SEQ ID NO: 3004 - RNA, 20 nt, Artificial Sequence
  synthesized
augugccgugguauuugggu

SEQ ID NO: 3005 - RNA, 20 nt, Artificial Sequence
  synthesized
caaauaccacggcacauggc

SEQ ID NO: 3006 - RNA, 20 nt, Artificial Sequence
  synthesized
caaauaccauggcacauggc

SEQ ID NO: 3007 - RNA, 20 nt, Artificial Sequence
  synthesized
cacggcacauggccugguau

SEQ ID NO: 3008 - RNA, 20 nt, Artificial Sequence
  synthesized
caggacccaaauaccacggc

SEQ ID NO: 3009 - RNA, 20 nt, Artificial Sequence
  synthesized
caggacccaaauaccauggc

SEQ ID NO: 3010 - RNA, 20 nt, Artificial Sequence
  synthesized
cauggcacauggccugguau

SEQ ID NO: 3011 - RNA, 20 nt, Artificial Sequence
  synthesized
uccaccugaugaagcagugc

What is claimed is:

1. An isolated guide RNA (gRNA) that targets a mutant human guanylate cyclase 2D (GUCY2D) allele, wherein the gRNA comprises a CRISPR RNA (crRNA) consisting of the nucleic acid sequence of SEQ ID NO: 237, 238, 241, 242, 247, 248, 293, 294, 307, 413, 414, 417, 418, or 3011.

2. A method for inactivating a mutant GUCY2D allele, the method comprising:
   (a) delivering the gRNA of claim 1 and a CRISPR nuclease to an isolated human cell that comprises a mutant GUCY2D allele and a functional GUCY2D allele; and
   (b) culturing the cell obtained in step a) such that the mutant GUCY2D allele is inactivated, and the functional GUCY2D allele remains intact.

3. The method of claim 2, wherein the mutant GUCY2D allele is inactivated by a frameshift mutation.

4. The method of claim 3, wherein the frameshift mutation creates an early stop codon in the mutant GUCY2D allele.

5. The method of claim 3, wherein the frameshift mutation results in nonsense-mediated mRNA decay of a transcript of the mutant GUCY2D allele.

6. The method of claim 1, wherein the inactivated mutant GUCY2D allele expresses a truncated protein and the intact functional GUCY2D allele expresses a functional protein.

* * * * *